US012662680B2

(12) United States Patent
Kolen

(10) Patent No.: US 12,662,680 B2
(45) Date of Patent: Jun. 23, 2026

(54) MICROORGANISMS FOR DITERPENE PRODUCTION

(71) Applicants: DSM IP ASSETS B.V., Heerlen (NL); Cargill, Incorporated, Wayzata, MN (US)

(72) Inventor: Catharina Petronella Antonia Maria Kolen, Echt (NL)

(73) Assignees: DSM IP ASSETS B.V., Heerlen (NL); Cargill, Incorporated

( * ) Notice: Subject to any disclaimer, the term of this patent is extended or adjusted under 35 U.S.C. 154(b) by 462 days.

(21) Appl. No.: 18/249,751

(22) PCT Filed: Oct. 21, 2021

(86) PCT No.: PCT/EP2021/079290

§ 371 (c)(1),
(2) Date: Apr. 20, 2023

(87) PCT Pub. No.: WO2022/084482

PCT Pub. Date: Apr. 28, 2022

(65) Prior Publication Data

US 2025/0290081 A1 Sep. 18, 2025

(30) Foreign Application Priority Data

Oct. 22, 2020 (EP) .................................... 20203470
Dec. 21, 2020 (EP) .................................... 20215939

(51) Int. Cl.

| | |
|---|---|
| ***C12N 15/81*** | (2006.01) |
| ***C12N 9/02*** | (2006.01) |
| ***C12N 9/04*** | (2006.01) |
| ***C12N 9/10*** | (2006.01) |
| ***C12N 9/12*** | (2006.01) |
| ***C12N 9/88*** | (2006.01) |
| ***C12N 9/90*** | (2006.01) |
| ***C12P 19/56*** | (2006.01) |

(52) U.S. Cl.

CPC ......... *C12N 15/815* (2013.01); *C12N 9/0006* (2013.01); *C12N 9/0042* (2013.01); *C12N 9/0071* (2013.01); *C12N 9/1051* (2013.01); *C12N 9/1085* (2013.01); *C12N 9/1205* (2013.01); *C12N 9/88* (2013.01); *C12N 9/90* (2013.01); *C12P 19/56* (2013.01); *C12Y 101/01088* (2013.01); *C12Y 114/13078* (2013.01); *C12Y 114/14* (2013.01); *C12Y 204/01* (2013.01); *C12Y 205/0101* (2013.01); *C12Y 205/01029* (2013.01); *C12Y 207/11001* (2013.01); *C12Y 402/03019* (2013.01); *C12Y 505/01013* (2013.01)

(58) Field of Classification Search

CPC .. C12N 15/815; C12N 9/0006; C12N 9/0042; C12N 9/0071; C12N 9/1051; C12N 9/1085; C12N 9/1205; C12Y 207/11001; C12P 19/56; C12P 5/007

See application file for complete search history.

(56) References Cited

U.S. PATENT DOCUMENTS

| | | | | |
|---|---|---|---|---|
| 8,435,758 | B2 * | 5/2013 | Hong | C12P 7/6472 435/254.2 |
| 10,844,414 | B2 * | 11/2020 | Anderson | A23L 27/36 |
| 2015/0031868 | A1 | 1/2015 | Lehmann et al. | |
| 2016/0153017 | A1 | 6/2016 | Van Der Hoeven et al. | |
| 2018/0057850 | A1 | 3/2018 | Bosch et al. | |
| 2018/0148697 | A1 | 5/2018 | Royer et al. | |
| 2020/0283815 | A1 | 9/2020 | Boer et al. | |
| 2021/0040491 | A1 | 2/2021 | Van Leeuwen et al. | |
| 2021/0147816 | A1 | 5/2021 | Boer et al. | |
| 2021/0238235 | A1 | 8/2021 | Van Leeuwen et al. | |
| 2021/0348136 | A1 | 11/2021 | Van Leeuwen et al. | |

FOREIGN PATENT DOCUMENTS

| | | | |
|---|---|---|---|
| WO | 2008053019 | A2 | 5/2008 |
| WO | 2011/153378 | A1 | 12/2011 |
| WO | 2011152278 | A1 | 12/2011 |
| WO | 2013/022989 | A2 | 2/2013 |
| WO | 2013/110673 | A1 | 8/2013 |

(Continued)

OTHER PUBLICATIONS

Manning et al., The Protein Kinase Complement of the Human Genome. Science, 2002, vol. 298: 1912-1934. (Year: 2002).*
Park et al., Global Analysis of Serine-Threonine Protein Kinase Genes in Neurospora crassa. Eukaryotic Cell, 2011, vol. 10(11): 1553-1564. (Year: 2011).*
International Search Report of International Patent Application No. PCT/EP2021/079290, mailed Feb. 4, 2022.
Huang et al., "PSK1 regulates expression of SOD1 involved in oxidative stress tolerance in yeast", FEMS Microbiol. Lett, 2014, vol. 350, pp. 154-160.

(Continued)

*Primary Examiner* — Ganapathirama Raghu
(74) *Attorney, Agent, or Firm* — McBee Moore & Vanik IP, LLC

(57) ABSTRACT

The invention disclosed herein relates generally to the field of recombinant production of a steviol glycoside, to the field of bioconversion of steviol into a steviol glycoside and to the field of bioconversion of a steviol glycoside into a further steviol glycoside. Particularly, the invention provides a process for recombinant production of a steviol glycoside, a process of bioconversion of steviol into a steviol glycoside, a process for bioconversion of a steviol glycoside into a further steviol glycoside and a composition comprising a steviol glycoside. More particularly, the invention relates to a microorganism that has a deficiency of a serine/threonine protein kinase and comprises a polynucleotide encoding a polypeptide having uridine diphosphate-dependent glucosyltransferase (UGT) activity.

15 Claims, 2 Drawing Sheets

Specification includes a Sequence Listing.

(56) References Cited

FOREIGN PATENT DOCUMENTS

| | | | | |
|---|---|---|---|---|
| WO | 2014122227 A2 | | 8/2014 | |
| WO | 2014191581 A2 | | 12/2014 | |
| WO | 2015/007748 A1 | | 1/2015 | |
| WO | 2016/038095 A2 | | 3/2016 | |
| WO | WO 2016/073740 A1 | * | 5/2016 | ............. C12P 19/56 |
| WO | 2016146711 A1 | | 9/2016 | |
| WO | 2016151046 A1 | | 9/2016 | |
| WO | 2016170045 A1 | | 10/2016 | |
| WO | 2017060318 A2 | | 4/2017 | |
| WO | 2018104238 A1 | | 6/2018 | |
| WO | 2019002264 A1 | | 1/2019 | |
| WO | 2019/033064 A1 | | 2/2019 | |
| WO | 2019211230 A1 | | 11/2019 | |

OTHER PUBLICATIONS

Rutter et al., "Coordinate Regulation of Sugar Flux and Translation by PAS Kinase", Oct. 4, 2002, Cell, vol. 111, pp. 17-28.

Humphrey et al., "Spatial organisation of four enzymes from Stevia rebaudiana that are involved in steviol glycoside synthesis", 2006, Plant Molecular Biology, vol. 61, pp. 47-62.

Mohamed et al., "UDP-dependent glycosyltransferases involved in the biosynthesis of steviol glycosides", 2011, Journal of Plant Physiology, vol. 168, pp. 1136-1141.

Olsson et al., "Microbial production of next-generation stevia sweeteners", 2016, Microb Cell Fact, vol. 15, No. 207, pp. 1-14.

* cited by examiner

Steviol
Steviol-13-O-glucoside
Steviol-19-O-Glucoside
Steviol-1,3-bioside
Steviol-1,2-bioside
Rubusoside
RebB
1,3-Stevioside (RebG)
Stevioside
RebQ
RebA
RebE
RebI
RebD
RebM

MICROORGANISMS FOR DITERPENE PRODUCTION

CROSS-REFERENCE TO RELATED APPLICATIONS

This application is the National Stage entry of International Application No. PCT/EP2021/079290, filed 21 Oct. 2021, which claims priority to European Patent Application No. 20203470.8, filed 22 Oct. 2020 and 20215939.8, filed 21 Dec. 2020, the entire contents of each of which is incorporated herein by reference.

REFERENCE TO SEQUENCE LISTING SUBMITTED AS ASCII TEXT FILE

Pursuant to the EFS-Web legal framework and 37 C.F.R. § 1.821-825 (see M.P.E.P. § 2442.03(a)), a Sequence Listing in the form of an ASCII text file (entitled Sequence_Listing_2919208-610000_ST25.txt" created on 27 Oct. 2023, and 755,206 bytes in size) is submitted concurrently with the instant application, and the entire contents of the Sequence Listing are incorporated herein by reference.

BACKGROUND

Technical Field

The invention disclosed herein relates generally to the field of recombinant production of a steviol glycoside, to the field of bioconversion of steviol into a steviol glycoside and to the field of bioconversion of a steviol glycoside into a further steviol glycoside. Particularly, the invention provides a process for recombinant production of a steviol glycoside, a process of bioconversion of steviol into a steviol glycoside, a process for bioconversion of a steviol glycoside into a further steviol glycoside and a composition comprising a steviol glycoside. More particularly, the invention relates to a microorganism that has a deficiency of a serine/threonine protein kinase and comprises a polynucleotide encoding a polypeptide having uridine diphosphate-dependent glucosyltransferase (UGT) activity.

Description of Related Art

The worldwide demand for high potency sweeteners is increasing and, with blending of different artificial sweeteners, becoming a standard practice. However, the demand for alternatives is expected to increase. The leaves of the perennial herb, *Stevia rebaudiana*, accumulate quantities of intensely sweet compounds known as steviol glycosides. Whilst the biological function of these compounds in the plant is unclear, they have commercial significance as alternative high potency sweeteners, with the added advantage that *Stevia* sweeteners are natural plant products. These sweet steviol glycosides have functional and sensory properties that appear to be superior to those of many high potency sweeteners. In addition, studies suggest that stevioside can reduce blood glucose levels in Type II diabetics and can reduce blood pressure in mildly hypertensive patients.

Steviol glycosides accumulate in *Stevia* leaves where they may comprise from 10 to 20% of the leaf dry weight. Stevioside and rebaudiosides are heat and pH stable and suitable for use in carbonated beverages and many other foods. Stevioside is e.g. between 110 and 270 times sweeter than sucrose and rebaudioside A is between 150 and 320 times sweeter compared to sucrose. In addition, rebaudioside D and Rebaudioside M are also high-potency steviol glycoside sweeteners which accumulate in *Stevia* leaves. Rebaudioside M in particular is present in trace amounts in certain *Stevia* variety leaves but has been suggested to have a superior taste profile if compared to the other steviol glycosides. Specifically, rebaudioside M seems to be lacking the bitter, liquorice after-taste which is typical of other steviol glycosides, in particular rebaudioside A. Commercially available steviol glycosides are mostly extracted from the *Stevia* plant. In *Stevia*, (−)-kaurenoic acid, an intermediate in gibberellic acid (GA) biosynthesis, is converted into the tetracyclic diterpene steviol, which further proceeds through a multi-step glucosylation pathway to form various steviol glycosides such as rebaudioside A, rebaudioside D and rebaudioside M. However, extract yields may vary and may be affected by agricultural and environmental conditions. In addition, *Stevia* cultivation requires substantial land area, a long time until harvest, intensive labour and additional costs for the extraction and purification of the glycosides.

As a consequence, more recently, interest has grown in producing steviol glycosides using fermentative or bioconversion processes. WO2011/153378A1, WO2013022989A2, WO2013/110673, and WO2015/007748 describe methods and microorganisms that may be used to produce at least the steviol glycosides such as rebaudioside A, rebaudioside D and rebaudioside M by fermentation and/or bioconversion.

Further improvement of such microorganisms is desirable in order that higher amounts of steviol glycosides may be produced and/or additional or new steviol glycosides and/or higher amounts of specific steviol glycosides and/or mixtures of steviol glycosides having desired ratios of different steviol glycosides is produced.

Novel, more standardized, clean single composition, no after-taste, sources of steviol glycosides are required to meet growing commercial demand for high potency, natural sweeteners.

SUMMARY

The application relates to a recombinant microorganism comprising, preferably expressing, one or more polynucleotide(s) encoding one or more polypeptide(s) having uridine diphosphate-dependent glycosyltransferase (UGT) activity, wherein said recombinant microorganism has a deficiency in a serine/threonine protein kinase polypeptide, for example a deficiency in a PSK1 polypeptide and/or a PSK2 polypeptide.

Said modification ultimately results in improved production of the steviol glycoside, in particular rebaudioside M and/or rebaudioside D, by the recombinant microorganism.

Also provided is

- a process for producing a steviol glycoside which process comprises culturing a recombinant microorganism according to the disclosure under conditions conducive to the production of the steviol glycoside, and optionally recovering the steviol glycoside;
- a process for producing a steviol glycoside comprising contacting steviol or steviol glycosides with a recombinant microorganism according to the disclosure, a fermentation broth comprising such recombinant microorganism, and optionally recovering the steviol glycoside.

Also provided are culture broths, steviol glycosides and foodstuff, feed or beverages obtained with the processes according to the disclosure.

DESCRIPTION OF THE SEQUENCE LISTING

Figure 1:
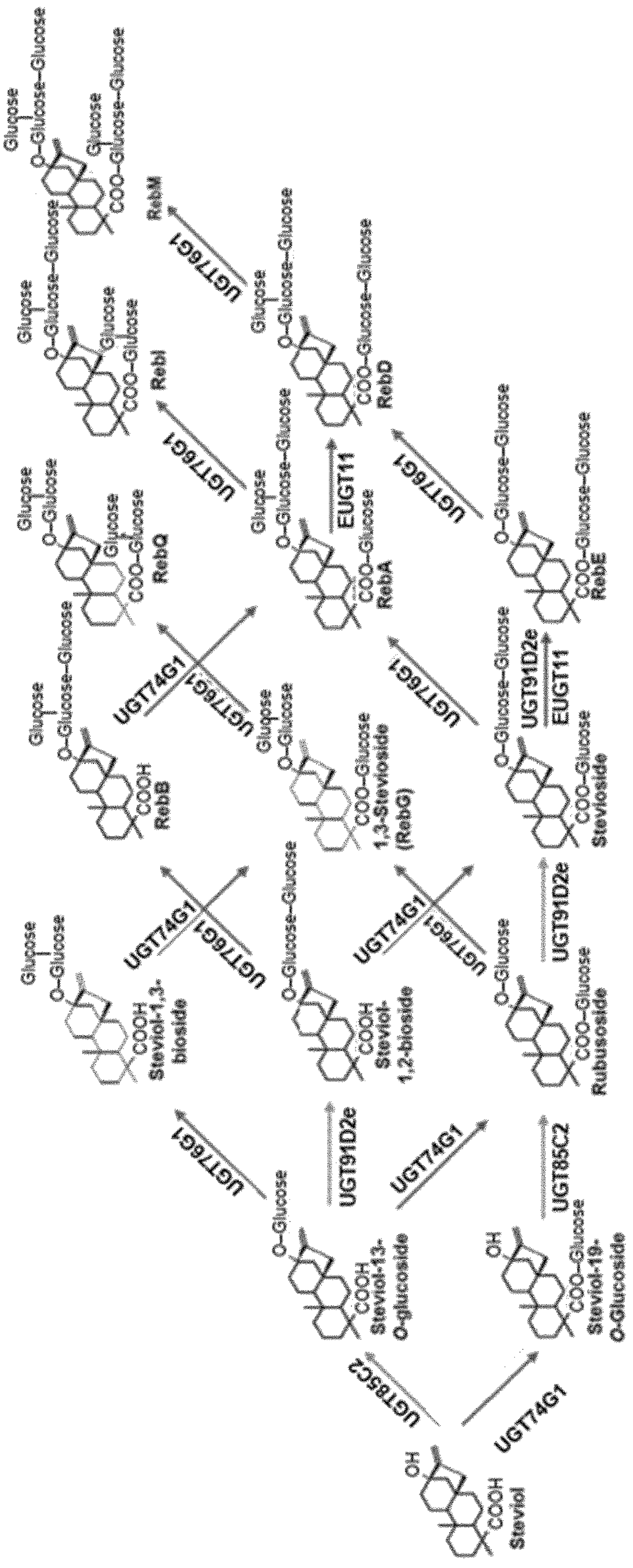
FIG. 1 sets out a schematic diagram of the potential pathways leading to biosynthesis of steviol glycosides. UGT85C2 is a UGT1; UGT74G1 is a UGT3; UGT76G1 is a UGT4; UGT91 D2e is a UGT2; EUGT11 is a UGT2.

A description of the sequences is set out in Table 1. Sequences described herein may be defined with reference to the sequence listing or with reference to the database accession numbers also set out in Table 1.

| SEQ ID NO: herein | SEQ ID NO: in reference application | Description |
|---|---|---|
| 1 | — | pRS417 5_3, *S. cerevisiae* destination vector |
| 2 | — | 50 bp connector |
| 3 | — | 1 kb fragment upstream of PSK1 |
| 4 | — | 50 bp connector |
| 5 | — | promoter in front of HygB |
| 6 | — | gene encoding resistance against hygromycin (HygB) |
| 7 | — | terminator behind HygB |
| 8 | — | 50 bp connector |
| 9 | — | 1 kb fragment downstream of PSK1 |
| 10 | — | 50 bp connector |
| 11 | — | [5]-5'-PSK1-Fw PCR primer |
| 12 | — | [C]-5'-PSK1-Rv PCR primer |
| 13 | — | DBC-05799 PCR primer |
| 14 | — | DBC-05800 PCR primer |
| 15 | — | [D]-3'-PSK1-Fw PCR primer |
| 16 | — | [3]-3'-PSK1-Rv PCR primer |
| 17 | — | 5'-PSK1-Fw PCR primer |
| 18 | — | DBC-10297 PCR primer |
| 19 | — | DBC-10296 PCR primer |
| 20 | — | 3'-PSK1-Rv PCR primer |
| 21 | — | 5'-Control-Fw PCR primer |
| 22 | — | DBC-05798 PCR primer |
| 23 | — | DBC-05801 PCR primer |
| 24 | — | 3'-Control-Rv PCR primer |
| 25 | — | PSK1 ORF |
| 26 | — | PSK1 PRT |
| 27 | SEQ ID NO: 79 in WO2014191581 | Truncated 3-hydroxy-3-methylglutaryl coenzyme A reductase |
| 28 | SEQ ID NO: 83 in WO2014191581 | Variant Geranylgeranyl diphosphate synthase |
| 29 | SEQ ID NO: 182 in WO2014191581 | Copalyl diphosphate synthase |
| 30 | SEQ ID NO: 183 in WO2014191581 | Kaurene synthase |
| 31 | SEQ ID NO: 24 in WO2013110673 | Kaurene oxidase |
| 32 | SEQ ID NO: 186 in WO2014191581 | Kaurene oxidase |
| 33 | SEQ ID NO: 185 in WO2014191581 | Kaurenoic acid 13-hydroxylase |
| 34 | SEQ ID NO: 3 in WO2017060318 | Kaurenoic acid 13-hydroxylase |
| 35 | SEQ ID NO: 188 in WO2014191581 | NADPH-cytochrome P450 reductase |
| 36 | SEQ ID NO: 189 in WO2014191581 | UDP-glucosyltransferase |
| 37 | SEQ ID NO: 192 in WO2014191581 | UDP-glucosyltransferase |
| 38 | SEQ ID NO: 49 in WO2014191581 | UDP-glucosyltransferase |
| 39 | SEQ ID NO: 191 in WO2014191581 | UDP-glucosyltransferase |
| 40 | SEQ ID NO: 4 in WO2016151046 | UDP-glucosyltransferase |
| 41 | SEQ ID NO: 193 in WO2014191581 | Promoter |
| 42 | SEQ ID NO: 194 in WO2014191581 | Terminator-Promoter |
| 43 | SEQ ID NO: 195 in WO2014191581 | Terminator-Promoter |
| 44 | SEQ ID NO: 196 in WO2014191581 | Terminator-Promoter |
| 45 | SEQ ID NO: 197 in WO2014191581 | |
| 46 | SEQ ID NO: 198 in WO2014191581 | |
| 47 | SEQ ID NO: 199 in WO2014191581 | Promoter |
| 48 | SEQ ID NO: 200 in WO2014191581 | Hygromycin resistance gene |
| 49 | SEQ ID NO: 66 in WO2016146711 | Promoter |
| 50 | SEQ ID NO: 65 in WO2016146711 | Promoter |
| 51 | SEQ ID NO: 63 in WO2016146711 | Promoter |
| 52 | SEQ ID NO: 64 in WO2016146711 | Promoter |
| 53 | SEQ ID NO: 193 in WO2013110673 | Promoter |
| 54 | SEQ ID NO: 68 in WO2016146711 | Promoter |
| 55 | SEQ ID NO: 74 in WO2016146711 | Terminator |
| 56 | SEQ ID NO: 71 in WO2016146711 | Terminator |
| 57 | — | Terminator |
| 58 | SEQ ID NO: 73 in WO2016146711 | Terminator |
| 59 | SEQ ID NO: 72 in WO2016146711 | Terminator |

-continued

| SEQ ID NO: herein | SEQ ID NO: in reference application | Description |
|---|---|---|
| 60 | SEQ ID NO: 69 in WO2016146711 | Terminator |
| 61 | SEQ ID NO: 2 in WO2014191581 | Q9FXV9, Lactuca sativa (Garden Lettuce) |
| 62 | SEQ ID NO: 4 in WO2014191581 | Q9FXV9, Lactuca sativa (Garden Lettuce) |
| 63 | SEQ ID NO: 6 in WO2014191581 | D2X8G0, Picea glauca |
| 64 | SEQ ID NO: 8 in WO2014191581 | Q45221, Bradyrhizobium japonicum |
| 65 | SEQ ID NO: 18 in WO2014191581 | O13284, *Phaeosphaeria* sp |
| 66 | SEQ ID NO: 20 in WO2014191581 | Q9UVY5, Gibberella fujikuroi |
| 67 | SEQ ID NO: 60 in WO2014191581 | O22667, Stevia rebaudiana |
| 68 | SEQ ID NO: 62 in WO2014191581 | O22667, Stevia rebaudiana |
| 69 | SEQ ID NO: 1 in WO2014191581 | Q9FXV9, Lactuca sativa (Garden Lettuce) |
| 70 | SEQ ID NO: 3 in WO2014191581 | Q9FXV9, Lactuca sativa (Garden Lettuce) |
| 71 | SEQ ID NO: 5 in WO2014191581 | D2X8G0, Picea glauca |
| 72 | SEQ ID NO: 7 in WO2014191581 | Q45221, Bradyrhizobium japonicum |
| 73 | SEQ ID NO: 17 in WO2014191581 | O13284, *Phaeosphaeria* sp |
| 74 | SEQ ID NO: 19 in WO2014191581 | Q9UVY5, Gibberella fujikuroi |
| 75 | SEQ ID NO: 59 in WO2014191581 | O22667, Stevia rebaudiana |
| 76 | SEQ ID NO: 61 in WO2014191581 | O22667, Stevia rebaudiana |
| 77 | SEQ ID NO: 141 in WO2014191581 | O22667, Stevia rebaudiana |
| 78 | SEQ ID NO: 142 in WO2014191581 | O22667, Stevia rebaudiana |
| 79 | SEQ ID NO: 151 in WO2014191581 | Q9FXV9, Lactuca sativa (Garden Lettuce) |
| 80 | SEQ ID NO: 152 in WO2014191581 | Q9FXV9, Lactuca sativa (Garden Lettuce) |
| 81 | SEQ ID NO: 153 in WO2014191581 | D2X8G0, Picea glauca |
| 82 | SEQ ID NO: 154 in WO2014191581 | Q45221, Bradyrhizobium japonicum |
| 83 | SEQ ID NO: 159 in WO2014191581 | O13284, *Phaeosphaeria* sp |
| 84 | SEQ ID NO: 160 in WO2014191581 | Q9UVY5, Gibberella fujikuroi |
| 85 | SEQ ID NO: 184 in WO2014191581 | |
| 86 | SEQ ID NO: 10 in WO2014191581 | Q9FXV8, Lactuca sativa (Garden Lettuce) |
| 87 | SEQ ID NO: 12 in WO2014191581 | Q9FXV8, Lactuca sativa (Garden Lettuce) |
| 88 | SEQ ID NO: 14 in WO2014191581 | D2X8G1, Picea glauca |
| 89 | SEQ ID NO: 16 in WO2014191581 | Q45222, Bradyrhizobium japonicum |
| 90 | SEQ ID NO: 18 in WO2014191581 | O13284, *Phaeosphaeria* sp |
| 91 | SEQ ID NO: 20 in WO2014191581 | Q9UVY5, Gibberella fujikuroi |
| 92 | SEQ ID NO: 64 in WO2014191581 | Q9XEI0, Stevia rebaudiana |
| 93 | SEQ ID NO: 66 in WO2014191581 | Q9XEI0, Stevia rebaudiana |
| 94 | SEQ ID NO: 9 in WO2014191581 | Q9FXV8, Lactuca sativa (Garden Lettuce) |
| 95 | SEQ ID NO: 11 in WO2014191581 | Q9FXV8, Lactuca sativa (Garden Lettuce) |
| 96 | SEQ ID NO: 13 in WO2014191581 | D2X8G1, Picea glauca |
| 97 | SEQ ID NO: 15 in WO2014191581 | Q45222, Bradyrhizobium japonicum |
| 98 | SEQ ID NO: 17 in WO2014191581 | O13284, *Phaeosphaeria* sp |
| 99 | SEQ ID NO: 19 in WO2014191581 | Q9UVY5, Gibberella fujikuroi |
| 100 | SEQ ID NO: 63 in WO2014191581 | Q9XEI0, Stevia rebaudiana |
| 101 | SEQ ID NO: 65 in WO2014191581 | Q9XEI0, Stevia rebaudiana |
| 102 | SEQ ID NO: 143 in WO2014191581 | Q9XEI0, Stevia rebaudiana |
| 103 | SEQ ID NO: 144 in WO2014191581 | Q9XEI0, Stevia rebaudiana |
| 104 | SEQ ID NO: 155 in WO2014191581 | Q9FXV8, Lactuca sativa (Garden Lettuce) |
| 105 | SEQ ID NO: 156 in WO2014191581 | Q9FXV8, Lactuca sativa (Garden Lettuce) |
| 106 | SEQ ID NO: 157 in WO2014191581 | D2X8G1, Picea glauca |
| 107 | SEQ ID NO: 158 in WO2014191581 | Q45222, Bradyrhizobium japonicum |
| 108 | SEQ ID NO: 159 in WO2014191581 | O13284, *Phaeosphaeria* sp |
| 109 | SEQ ID NO: 160 in WO2014191581 | Q9UVY5, Gibberella fujikuroi |
| 110 | SEQ ID NO: 184 in WO2014191581 | |
| 111 | SEQ ID NO: 22 in WO2014191581 | B5MEX5, Lactuca sativa (Garden Lettuce) |
| 112 | SEQ ID NO: 24 in WO2014191581 | B5MEX6, Lactuca sativa (Garden Lettuce) |
| 113 | SEQ ID NO: 26 in WO2014191581 | B5DBY4, Sphaceloma manihoticola |
| 114 | SEQ ID NO: 68 in WO2014191581 | Q4VCL5, Stevia rebaudiana |
| 115 | SEQ ID NO: 86 in WO2014191581 | |
| 116 | SEQ ID NO: 21 in WO2014191581 | |
| 117 | SEQ ID NO: 23 in WO2014191581 | |
| 118 | SEQ ID NO: 25 in WO2014191581 | |
| 119 | SEQ ID NO: 67 in WO2014191581 | |
| 120 | SEQ ID NO: 85 in WO2014191581 | |
| 121 | SEQ ID NO: 145 in WO2014191581 | |
| 122 | SEQ ID NO: 161 in WO2014191581 | |
| 123 | SEQ ID NO: 162 in WO2014191581 | |
| 124 | SEQ ID NO: 163 in WO2014191581 | |
| 125 | SEQ ID NO: 180 in WO2014191581 | |
| 126 | SEQ ID NO: 28 in WO2014191581 | |
| 127 | SEQ ID NO: 30 in WO2014191581 | |
| 128 | SEQ ID NO: 32 in WO2014191581 | |
| 129 | SEQ ID NO: 34 in WO2014191581 | |
| 130 | SEQ ID NO: 70 in WO2014191581 | |
| 131 | SEQ ID NO: 90 in WO2014191581 | |
| 132 | SEQ ID NO: 92 in WO2014191581 | |
| 133 | SEQ ID NO: 94 in WO2014191581 | |
| 134 | SEQ ID NO: 96 in WO2014191581 | |
| 135 | SEQ ID NO: 98 in WO2014191581 | |

-continued

| SEQ ID NO: herein | SEQ ID NO: in reference application | Description |
|---|---|---|
| 136 | SEQ ID NO: 27 in WO2014191581 | |
| 137 | SEQ ID NO: 29 in WO2014191581 | |
| 138 | SEQ ID NO: 31 in WO2014191581 | |
| 139 | SEQ ID NO: 33 in WO2014191581 | |
| 140 | SEQ ID NO: 69 in WO2014191581 | |
| 141 | SEQ ID NO: 89 in WO2014191581 | |
| 142 | SEQ ID NO: 91 in WO2014191581 | |
| 143 | SEQ ID NO: 93 in WO2014191581 | |
| 144 | SEQ ID NO: 95 in WO2014191581 | |
| 145 | SEQ ID NO: 97 in WO2014191581 | |
| 146 | SEQ ID NO: 146 in WO2014191581 | |
| 147 | SEQ ID NO: 164 in WO2014191581 | |
| 148 | SEQ ID NO: 165 in WO2014191581 | |
| 149 | SEQ ID NO: 166 in WO2014191581 | |
| 150 | SEQ ID NO: 167 in WO2014191581 | |
| 151 | SEQ ID NO: 36 in WO2014191581 | |
| 152 | SEQ ID NO: 38 in WO2014191581 | |
| 153 | SEQ ID NO: 72 in WO2014191581 | |
| 154 | SEQ ID NO: 35 in WO2014191581 | |
| 155 | SEQ ID NO: 37 in WO2014191581 | |
| 156 | SEQ ID NO: 71 in WO2014191581 | |
| 157 | SEQ ID NO: 147 in WO2014191581 | |
| 158 | SEQ ID NO: 168 in WO2014191581 | |
| 159 | SEQ ID NO: 169 in WO2014191581 | |
| 160 | SEQ ID NO: 88 in WO2014191581 | |
| 161 | SEQ ID NO: 100 in WO2014191581 | |
| 162 | SEQ ID NO: 102 in WO2014191581 | |
| 163 | SEQ ID NO: 104 in WO2014191581 | |
| 164 | SEQ ID NO: 106 in WO2014191581 | |
| 165 | SEQ ID NO: 108 in WO2014191581 | |
| 166 | SEQID NO: 110 in WO2014191581 | |
| 167 | SEQ ID NO: 112 in WO2014191581 | |
| 168 | SEQ ID NO: 87 in WO2014191581 | |
| 169 | SEQ ID NO: 99 in WO2014191581 | |
| 170 | SEQ ID NO: 101 in WO2014191581 | |
| 171 | SEQ ID NO: 103 in WO2014191581 | |
| 172 | SEQ ID NO: 105 in WO2014191581 | |
| 173 | SEQ ID NO: 107 in WO2014191581 | |
| 174 | SEQ ID NO: 109 in WO2014191581 | |
| 175 | SEQ ID NO: 111 in WO2014191581 | |
| 176 | SEQ ID NO: 181 in WO2014191581 | |
| 177 | SEQ ID NO: 40 in WO2014191581 | |
| 178 | SEQ ID NO: 42 in WO2014191581 | |
| 179 | SEQ ID NO: 44 in WO2014191581 | |
| 180 | SEQ ID NO: 46 in WO2014191581 | |
| 181 | SEQ ID NO: 48 in WO2014191581 | |
| 182 | SEQ ID NO: 74 in WO2014191581 | |
| 183 | SEQ ID NO: 39 in WO2014191581 | |
| 184 | SEQ ID NO: 41 in WO2014191581 | |
| 185 | SEQ ID NO: 43 in WO2014191581 | |
| 186 | SEQ ID NO: 45 in WO2014191581 | |
| 187 | SEQ ID NO: 47 in WO2014191581 | |
| 188 | SEQ ID NO: 173 in WO2014191581 | |
| 189 | SEQ ID NO: 148 in WO2014191581 | |
| 190 | SEQ ID NO: 170 in WO2014191581 | |
| 191 | SEQ ID NO: 171 in WO2014191581 | |
| 192 | SEQ ID NO: 172 in WO2014191581 | |
| 193 | SEQ ID NO: 173 in WO2014191581 | |
| 194 | SEQ ID NO: 174 in WO2014191581 | |
| 195 | SEQ ID NO: 50 in WO2014191581 | |
| 196 | SEQ ID NO: 52 in WO2014191581 | |
| 197 | SEQ ID NO: 76 in WO2014191581 | |
| 198 | SEQ ID NO: 49 in WO2014191581 | |
| 199 | SEQ ID NO: 51 in WO2014191581 | |
| 200 | SEQ ID NO: 75 in WO2014191581 | |
| 201 | SEQ ID NO: 149 in WO2014191581 | |
| 202 | SEQ ID NO: 175 in WO2014191581 | |
| 203 | SEQ ID NO: 176 in WO2014191581 | |
| 204 | SEQ ID NO: 80 in WO2014191581 | |
| 205 | SEQ ID NO: 79 in WO2014191581 | |
| 206 | SEQ ID NO: 82 in WO2014191581 | |
| 207 | SEQ ID NO: 81 in WO2014191581 | |
| 208 | SEQ ID NO: 84 in WO2014191581 | |
| 209 | SEQ ID NO: 83 in WO2014191581 | |
| 210 | SEQ ID NO: 53 in WO2014191581 | |
| 211 | SEQ ID NO: 54 in WO2014191581 | |

-continued

| SEQ ID NO: herein | SEQ ID NO: in reference application | Description |
|---|---|---|
| 212 | SEQ ID NO: 55 in WO2014191581 | |
| 213 | SEQ ID NO: 56 in WO2014191581 | |
| 214 | SEQ ID NO: 57 in WO2014191581 | |
| 215 | SEQ ID NO: 58 in WO2014191581 | |
| 216 | SEQ ID NO: 77 in WO2014191581 | |
| 217 | SEQ ID NO: 78 in WO2014191581 | |
| 218 | SEQ ID NO: 113 in WO2014191581 | |
| 219 | SEQ ID NO: 114 in WO2014191581 | |
| 220 | SEQ ID NO: 115 in WO2014191581 | |
| 221 | SEQ ID NO: 116 in WO2014191581 | |
| 222 | SEQ ID NO: 117 in WO2014191581 | |
| 223 | SEQ ID NO: 118 in WO2014191581 | |
| 224 | SEQ ID NO: 119 in WO2014191581 | |
| 225 | SEQ ID NO: 120 in WO2014191581 | |
| 226 | SEQ ID NO: 121 in WO2014191581 | |
| 227 | SEQ ID NO: 122 in WO2014191581 | |
| 228 | SEQ ID NO: 123 in WO2014191581 | |
| 229 | SEQ ID NO: 124 in WO2014191581 | |
| 230 | SEQ ID NO: 125 in WO2014191581 | |
| 231 | SEQ ID NO: 126 in WO2014191581 | |
| 232 | SEQ ID NO: 127 in WO2014191581 | |
| 233 | SEQ ID NO: 128 in WO2014191581 | |
| 234 | SEQ ID NO: 129 in WO2014191581 | |
| 235 | SEQ ID NO: 130 in WO2014191581 | |
| 236 | SEQ ID NO: 131 in WO2014191581 | |
| 237 | SEQ ID NO: 132 in WO2014191581 | |
| 238 | SEQ ID NO: 133 in WO2014191581 | |
| 239 | SEQ ID NO: 134 in WO2014191581 | |
| 240 | SEQ ID NO: 135 in WO2014191581 | |
| 241 | SEQ ID NO: 136 in WO2014191581 | |
| 242 | SEQ ID NO: 137 in WO2014191581 | |
| 243 | SEQ ID NO: 138 in WO2014191581 | |
| 244 | SEQ ID NO: 139 in WO2014191581 | |
| 245 | SEQ ID NO: 140 in WO2014191581 | |
| 246 | SEQ ID NO: 189 in WO2014191581 | |
| 247 | SEQ ID NO: 190 in WO2014191581 | |
| 248 | SEQ ID NO: 191 in WO2014191581 | |
| 249 | SEQ ID NO: 192 in WO2014191581 | |

General Definitions

In order that the present disclosure can be more readily understood, certain terms are first defined. As used in this application, except as otherwise expressly provided herein, each of the following terms shall have the meaning set forth below. Additional definitions are set forth throughout the application. In case of conflict, the present application including the definitions will control. Unless otherwise required by context, singular terms shall include pluralities and plural terms shall include the singular. All publications, patents and other references mentioned herein are incorporated by reference in their entireties for all purposes as if each individual publication or patent application were specifically and individually indicated to be incorporated by reference.

Unless defined otherwise, all technical and scientific terms used herein have the same meaning as commonly understood by one of ordinary skill in the art to which this disclosure is related.

Although methods and materials similar or equivalent to those described herein can be used in practice or testing of the present disclosure, suitable methods and materials are described below. The materials, methods and examples are illustrative only and are not intended to be limiting. Other features and advantages of the disclosure will be apparent from the detailed description and from the claims.

As used in the present disclosure and claims, the singular forms "a," "an," and "the" include plural forms unless the context clearly dictates otherwise. As an example, "an element" may mean one element or more than one element, i.e. "at least one element".

Unless specifically stated or obvious from context, as used herein, the term "or" is understood to be inclusive. The term "and/or" as used in a phrase such as "A and/or B" herein is intended to include both "A and B," "A or B," "A," and "B." Likewise, the term "and/or" as used in a phrase such as "A, B, and/or C" is intended to encompass each of the following embodiments: A, B, and C; A, B, or C; A or C; A or B; B or C; A and C; A and B; B and C; A (alone); B (alone); and C (alone).

The term "about" refers to a value or composition that is within an acceptable error range for the particular value or composition as determined by one of ordinary skill in the art, which will depend in part on how the value or composition is measured or determined, i.e., the limitations of the measurement system. For example, "about" or "comprising essentially of" can mean within 1 or more than 1 standard deviation per the practice in the art. Alternatively, "about" or "comprising essentially of" can mean a range of up to 20%. Furthermore, particularly with respect to biological systems or processes, the terms can mean up to an order of magnitude or up to 5-fold of a value. When particular values or compositions are provided in the application and claims, unless otherwise stated, the meaning of "about" or "comprising essentially of" should be assumed to be within an acceptable error range for that particular value or composition.

A "nucleic acid molecule" or "polynucleotide" (the terms are used interchangeably herein) is represented by a nucleotide sequence.

A "polypeptide" is represented by an amino acid sequence.

The term "isolated polypeptide" as used herein means a polypeptide that is removed or purified from at least one component, e.g. components present in the cell where the polypeptide is produced and or the fermentation broth or crude or cell extract.

The term "mature polypeptide" is defined herein as a polypeptide in its final form(s) and is obtained after translation of a mRNA into polypeptide, post-translational modifications of said polypeptide in or outside the cell. Post-translational modifications include N-terminal processing, C-terminal truncation, glycosylation, phosphorylation and removal of leader sequences such as signal peptides, propeptides and/or prepropeptides as defined herein by cleavage.

The term "naturally-occurring" as used herein refers to processes, events, or products that occur in their relevant form in nature. By contrast, "not naturally-occurring" refers to processes, events, or products whose existence or form involves the hand of man. The term "non-naturally occurring is herein synonymous with "man-made". Generally, the term "naturally-occurring" with regard to polypeptides or nucleic acids can be used interchangeable with the term "wild-type" or "native". It refers to polypeptide or nucleic acids encoding a polypeptide, having an amino acid sequence or polynucleotide sequence, respectively, identical to that found in nature. Naturally occurring polypeptides include native polypeptides, such as those polypeptides naturally expressed or found in a particular cell. Naturally occurring polynucleotides include native polynucleotides such as those polynucleotides naturally found in the genome of a particular cell. Additionally, a sequence that is wild-type or naturally-occurring may refer to a sequence from which a variant or a synthetic sequence is derived.

The term "expression" includes any step involved in the production of (a) polypeptide(s) including, but not limited to, transcription, post transcriptional modification, translation, post-translational modification, and secretion.

The terms "serine/threonine protein kinase", "PAS kinase", "PSK" as used herein have the same meaning and are used interchangeably. Said terms as used herein refers to PAS-domain containing serine/threonine protein kinases that transfer phosphates to the oxygen atom of a serine or threonine sidechain in proteins (EC 2.7.11.1). Said enzymes are involved in e.g. the control of sugar metabolism and translation. Said enzymes encompass enzymes known as "serine/threonine protein kinase 1" and "serine/threonine protein kinase 2". The terms "serine/threonine protein kinase 1", "PAS kinase 1", "PSK1" as used herein have the same meaning and are used interchangeably. The terms "serine/threonine protein kinase 2", "PAS kinase 2", "PSK2" as used herein have the same meaning and are used interchangeably. In yeast, PSK1 and PSK2 are two PAS kinase paralogs.

Deficiency in a recombinant microorganism of a serine/threonine protein kinase polypeptide means herewith that the recombinant microorganism is deficient in the production of the polypeptide and said deficiency is herein defined as a phenotypic feature wherein the recombinant microorganism: a) produces less of the polypeptide and/or b) has a reduced expression level or has a reduced translation level of the mRNA transcribed from a gene encoding the polypeptide and/or c) produces the polypeptide having decreased activity; and combinations of one or more of these possibilities as compared to a corresponding recombinant microorganism that is not deficient in a serine/threonine protein kinase, when analyzed under substantially identical conditions. The deficiency of a serine/threonine protein kinase in a recombinant microorganism is typically the result of a modification in its genome.

Herein, a gene is defined as a polynucleotide containing an open reading frame (ORF) together with its transcriptional control elements (promoter and terminator), the ORF being the region on the gene that will be transcribed and translated into the polypeptide.

Deficiency in production of a polypeptide in a recombinant microorganism may be measured by determining the amount and/or (specific) activity of the relevant polypeptide produced by the recombinant microorganism modified in its genome and/or it may be measured by determining the amount of (free) mRNA transcribed from a gene encoding the polypeptide and/or it may be measured by determining the amount of a product produced by the polypeptide in a recombinant microorganism modified in its genome as defined above and/or it may be measured by gene or genome sequencing if compared to the parent (recombinant) microorganism which has not been modified in its genome. Deficiency in the production of a polypeptide can be measured using any assay available to the skilled person, such as transcriptional profiling, Northern blotting, RT-PCR, Q-PCR and Western blotting.

Modification of a genome of a recombinant microorganism is herein defined as any event resulting in a change in a polynucleotide in the genome of the recombinant microorganism. A modification is construed as one or more modifications. Modification can be introduced by e.g. classical strain improvement such as random mutagenesis followed by selection. Modification may be accomplished by the introduction (insertion), substitution or removal (deletion) of one or more nucleotides in a polynucleotide. This modification may for example be in a coding sequence or a regulatory element required for the transcription or translation of the polynucleotide. For example, nucleotides may be inserted or removed so as to result in the introduction of a stop codon, the removal of a start codon or a change or a frameshift of the open reading frame of a coding sequence. The modification of a coding sequence or a regulatory element thereof may be accomplished by site-directed or random mutagenesis, DNA shuffling methods, DNA reassembly methods, gene synthesis (see for example Young and Dong, (2004), *Nucleic Acids Research* 32, (7) electronic access nar.oupjournals.org/cgi/reprint/32/7/e59 or Gupta et al. (1968), *Proc. Natl. Acad. Sci USA,* 60:1338-1344; Scarpulla et al. (1982), *Anal. Biochem.* 121:356-365; Stemmer et al. (1995), *Gene* 164:49-53), or PCR generated mutagenesis in accordance with methods known in the art. Examples of random mutagenesis procedures are well known in the art, such as for example chemical (NTG for example) mutagenesis or physical (UV for example) mutagenesis. Examples of directed mutagenesis procedures are the QuickChange™ site-directed mutagenesis kit (Stratagene Cloning Systems, La Jolla, CA), the 'The Altered Sites® II in vitro Mutagenesis Systems' (Promega Corporation) or by overlap extension using PCR as described in Gene. 1989 April 15; 77(1):51-9. (Ho S N, Hunt H D, Horton R M, Pullen J K, Pease L R "Site-directed mutagenesis by overlap extension using the polymerase chain reaction") or using PCR as described in *Molecular Biology: Current Innovations and Future Trends*. (Eds. A. M. Griffin and H. G. Griffin. ISBN 1-898486 Jan. 8; 1995 *Horizon Scientific Press*, PO Box 1, Wymondham, Norfolk, U.K.).

A modification in the genome can be determined by comparing the polynucleotide sequence of the modified recombinant microorganism to the polynucleotide sequence of the non-modified recombinant microorganism. Sequencing of a polynucleotide and genome sequencing can be done using standard methods known to the person skilled in the art, for example using Sanger sequencing technology and/or next generation sequencing technologies such as Illumina GA2, Roche 454, etc. as reviewed in Elaine R. Mardis (2008), Next-Generation DNA Sequencing Methods, Annual Review of Genomics and Human Genetics, 9: 387-402. (doi:10.1146/annurev.genom.9.081307.164359).

Exemplary methods of modification are based on techniques of gene replacement, gene deletion, or gene disruption.

For example, in case of replacement of a polynucleotide, polynucleotide construct or expression cassette, an appropriate polynucleotide may be introduced at the target locus to be replaced. The appropriate polynucleotide may be present on a cloning vector. Exemplary integrative cloning vectors comprise a DNA fragment, which is homologous to the polynucleotide and/or has homology to the polynucleotides flanking the locus to be replaced for targeting the integration of the cloning vector to this pre-determined locus. In order to promote targeted integration, the cloning vector may be linearized prior to transformation of the microorganism. In some embodiments, linearization is performed such that at least one or either end of the cloning vector is flanked by polynucleotide sequences homologous to the polynucleotide (or flanking sequences) to be replaced. This process is called homologous recombination and this technique may also be used in order to achieve (partial) gene deletion or gene disruption.

For example, for gene disruption, a polynucleotide corresponding to the endogenous polynucleotide may be replaced by a defective polynucleotide, that is a polynucleotide that fails to produce a (fully functional) protein. By homologous recombination, the defective polynucleotide replaces the endogenous polynucleotide. It may be desirable that the defective polynucleotide also encodes a marker, which may be used for selection of transformants in which the polynucleotide has been modified.

Alternatively, modification due to which the recombinant microorganism has a deficiency in a serine/threonine protein kinase may be performed by established anti-sense techniques using a polynucleotide with a polynucleotide complementary to the polynucleotide encoding the serine/threonine protein kinase polypeptide. More specifically, expression of the serine/threonine protein kinase polynucleotide by a recombinant microorganism may be reduced or eliminated by introducing a polynucleotide with a sequence complementary to the sequence of the polynucleotide encoding the serine/threonine protein kinase which may be transcribed in the recombinant microorganism and is capable of hybridizing to the serine/threonine protein kinase mRNA produced in the recombinant microorganism. Under conditions allowing the complementary anti-sense polynucleotide to hybridize to the serine/threonine protein kinase mRNA, the amount of protein translated is thus reduced or eliminated. An example of expressing an antisense-RNA is shown in Appl. Environ. Microbiol. 2000 February; 66(2):775-82. (*Characterization of a foldase, protein disulfide isomerase A, in the protein secretory pathway of Aspergillus niger*. Ngiam C, Jeenes D J, Punt P J, Van Den Hondel C A, Archer D B) or (Zrenner R, Willmitzer L, Sonnewald U. *Analysis of the expression of potato uridinediphosphate-glucose pyrophosphorylase and its inhibition by antisense RNA. Planta.* (1993); 190(2):247-52.).

Furthermore, modification, downregulation or inactivation of a serine/threonine protein kinase polypeptide may be obtained via the RNA interference (RNAi) technique (FEMS Microb. Lett. 237 (2004): 317-324). In this method, identical sense and antisense parts of the serine/threonine protein kinase encoding polynucleotide which expression is to be affected, are cloned behind each other with a nucleotide spacer in between, and inserted into an expression vector. After such a molecule is transcribed, formation of small nucleotide fragments will lead to a targeted degradation of the mRNA, which is to be affected. The elimination of the specific serine/threonine protein kinase mRNA can be to various extents. The RNA interference techniques described in WO2008/053019, WO2005/05672A1, WO2005/026356A1, Oliveira et al., "*Efficient cloning system for construction of gene silencing vectors in Aspergillus niger*" (2008) *Appl. Microbiol. and Biotechnol.* 80 (5): 917-924 and/or Barnes et al., "siRNA as a molecular tool for use in *Aspergillus niger*" (2008) *Biotechnology Letters* 30 (5): 885-890 may be used for downregulation, modification or inactivation of a polynucleotide.

The application relates to a recombinant microorganism.

A microorganism as disclosed herein may be a prokaryotic, archaebacterial or eukaryotic cell.

A prokaryotic cell may, but is not limited to, a bacterial cell. Bacterial cell may be Gram-negative or Gram-positive bacteria. Examples of bacteria include, but are not limited to, bacteria belonging to the genus *Bacillus* (e.g., *B. subtilis, B. amyloliquefaciens, B. licheniformis, B. puntis, B. megaterium, B. halodurans, B. pumilus*), *Acinetobacter, Nocardia, Xanthobacter, Escherichia* (e.g., *E. coli*), *Streptomyces, Erwinia, Klebsiella, Serratia* (e.g., *S. marcessans*), *Pseudomonas* (e.g., *P. aeruginosa, P. fluorescens*), *Salmonella* (e.g., *S. typhimurium, S. typhi*), *Anabaena, Caulobactert, Gluconobacter, Rhodobacter, Paracoccus, Brevibacterium, Corynebacterium, Rhizobium* (*Sinorhizobium*), *Flavobacterium, Klebsiella, Enterobacter, Lactobacillus, Lactococcus, Methylobacterium, Staphylococcus*. Bacteria also include, but are not limited to, photosynthetic bacteria (e.g., green non-sulfur bacteria green sulfur bacteria purple sulfur bacteria and purple non-sulfur bacteria.

A eukaryotic cell may be, but is not limited to, fungus (e.g. a yeast or a filamentous fungus), an algae, a plant cell, a cell line.

A eukaryotic cell may be a fungus, such as a filamentous fungus or yeast. Filamentous fungal strains include, but are not limited to, strains of *Acremonium, Aspergillus* (e.g. *A. niger, A oryzae, A. nidulans*), *Agaricus, Aureobasidium, Coprinus, Cryptococcus, Corynascus, Chrysosporium, Filibasidium, Fusarium, Humicola, Magnaporthe, Monascus, Mucor, Myceliophthora, Mortierella, Neocallimastix, Neurospora, Paecilomyces, Penicillium* (e.g. *P. chrysogenum, P. camemberti*), *Piromyces, Phanerochaete Pleurotus, Podospora, Pycnoporus, Rhizopus, Schizophyllum, Sordaria, Talaromyces, Rasamsonia* (e.g. *Rasamsonia emersonii*), *Thermoascus, Thielavia, Tolypocladium, Trametes* and *Trichoderma.*

Yeast cells may be selected from the genera: *Saccharomyces* (e.g., *S. cerevisiae, S. bayanus, S. pastorianus, S. carlsbergensis*), *Kluyveromyces, Candida* (e.g., *C. rugosa, C. revkaufi, C. pulcherrima, C. tropicalis, C. utilis*), *Pichia* (e.g., *P. pastoris*), *Schizosaccharomyces, Issatchenkia,*

*Zygosaccharomyces, Hansenula, Kloeckera, Schwanniomyces*, and *Yarrowia* (e.g., *Y. lipolytica*, formerly classified as *Candida lipolytica*).

The cell may be an algae, a microalgae or a marine eukaryote. The cell may be a Labyrinthulomycetes cell, preferably of the order Thraustochytriales, more preferably of the family Thraustochytriaceae, more preferably a member of a genus selected from the group consisting of *Aurantiochytrium, Oblongichytrium, Schizochytrium, Thraustochytrium*, and *Ulkenia*, even more preferably *Schizochytrium* sp. ATCC #20888.

In one embodiment, the recombinant cell as disclosed herein belongs to one of the genera *Saccharomyces, Aspergillus, Pichia, Kluyveromyces, Candida, Hansenula, Humicola, Issatchenkia, Trichosporon, Brettanomyces, Pachysolen, Yarrowia, Yamadazyma* or *Escherichia*, for example a *Saccharomyces cerevisiae* cell, a *Yarrowia lipolytica* cell, a *Candida krusei* cell, an *Issatchenkia orientalis* cell or an *Escherichia coli* cell.

As used herein, a recombinant microorganism is defined as a microorganism which is preferably genetically modified or transformed/transfected with one or more of the polynucleotides as defined elsewhere herein. The presence of the one or more such polynucleotides alters the ability of the microorganism to produce a steviol glycoside. A microorganism that is not transformed/transfected or genetically modified, is not a recombinant microorganism and does typically not comprise one or more of the polynucleotides enabling the microorganism to produce a steviol glycoside. Hence, a non-transformed/non-transfected microorganism is typically a microorganism that does not naturally produce a steviol glycoside, although a microorganism which naturally produces a steviol glycoside and which has been modified as disclosed herein (and which thus has an altered ability to produce a steviol glycoside) is considered a recombinant microorganism as disclosed herein.

Sequence identity is herein defined as a relationship between two or more amino acid (polypeptide or protein) sequences or two or more nucleic acid (polynucleotide) sequences, as determined by comparing the sequences. Usually, sequence identities or similarities are compared over the whole length of the sequences compared.

A comparison of sequences and determination of percentage of sequence identity between two sequences can be accomplished using a mathematical algorithm. The skilled person will be aware of the fact that several different computer programs are available to align two sequences and determine the identity between two sequences (Kruskal, J. B. (1983) An overview of sequence comparison In D. Sankoff and J. B. Kruskal, (ed.), Time warps, string edits and macromolecules: the theory and practice of sequence comparison, pp. 1-44 Addison Wesley). The percent sequence identity between two amino acid sequences or between two nucleotide sequences may be determined using the Needleman and Wunsch algorithm for the alignment of two sequences. (Needleman, S. B. and Wunsch, C. D. (1970) J. Mol. Biol. 48, 443-453). Both amino acid sequences and nucleotide sequences can be aligned by the algorithm. The Needleman-Wunsch algorithm has been implemented in the computer program NEEDLE. For the purpose of this disclosure the NEEDLE program from the EMBOSS package was used (version 2.8.0 or higher, EMBOSS: The European Molecular Biology Open Software Suite (2000) Rice, P. Longden, I. and Bleasby, A. Trends in Genetics 16, (6) pp 276-277, emboss.bioinformatics.nl). For protein sequences EBLOSUM62 is used for the substitution matrix. For nucleotide sequence, EDNAFULL is used. The optional parameters used are a gap-open penalty of 10 and a gap extension penalty of 0.5. The skilled person will appreciate that all these different parameters will yield slightly different results but that the overall percentage identity of two sequences is not significantly altered when using different algorithms.

After alignment by the program NEEDLE as described above the percentage of sequence identity between a query sequence and a sequence of the disclosure is calculated as follows: Number of corresponding positions in the alignment showing an identical amino acid or identical nucleotide in both sequences divided by the total length of the alignment after subtraction of the total number of gaps in the alignment. The identity defined as herein can be obtained from NEEDLE by using the NOBRIEF option and is labelled in the output of the program as "longest-identity". The nucleic acid and protein sequences of the present disclosure can further be used as a "query sequence" to perform a search against public databases to, for example, identify other family members or related sequences. Such searches can be performed using the BLASTN and BLASTX programs (version 2.0) of Altschul, et al. (1990) J. Mol. Biol. 215:403-10. BLAST nucleotide searches can be performed with the BLASTN program, score=100, wordlength=12 to obtain nucleotide sequences homologous to nucleic acid molecules of the disclosure. BLAST protein searches can be performed with the BLASTX program, score=50, wordlength=3 to obtain amino acid sequences homologous to protein molecules of the disclosure. To obtain gapped alignments for comparison purposes, Gapped BLAST can be utilized as described in Altschul et al., (1997) Nucleic Acids Res. 25 (17): 3389-3402. When utilizing BLAST and Gapped BLAST programs, the default parameters of the respective programs (e.g., BLASTX and BLASTN) can be used. See the homepage of the National Center for Biotechnology Information at ncbi.nlm.nih.gov.

A polynucleotide which has at least about 10%, about 15%, about 20%, such as at least about 25%, about 30%, about 40%, about 50%, about 55%, about 60%, about 65%, about 70%, about 75%, about 80%, about 85%, about 90%, about 95%, about 96%, about 97%, about 98%, or about 99% sequence identity with a polynucleotide as mentioned may be used in the embodiments herein.

To increase the likelihood that the introduced enzymes are expressed in active form in a recombinant microorganism as disclosed herein, the corresponding encoding polynucleotide may be adapted to optimise its codon usage to that of the chosen recombinant microorganism. The adaptiveness of the polynucleotides encoding the enzymes to the codon usage of the chosen recombinant microorganism may be expressed as codon adaptation index (CAI). The codon adaptation index is herein defined as a measurement of the relative adaptiveness of the codon usage of a gene towards the codon usage of highly expressed genes. The relative adaptiveness (w) of each codon is the ratio of the usage of each codon, to that of the most abundant codon for the same amino acid. The CAI index is defined as the geometric mean of these relative adaptiveness values. Non-synonymous codons and termination codons (dependent on genetic code) are excluded. CAI values range from 0 to 1, with higher values indicating a higher proportion of the most abundant codons (see Sharp and Li, 1987, Nucleic Acids Research 15: 1281-1295; also see: Jansen et al., 2003, Nucleic Acids Res. 31(8):2242-51). An adapted polynucleotide may have a CAI of at least 0.2, 0.3, 0.4, 0.5, 0.6 or 0.7.

The recombinant microorganism as disclosed herein be genetically modified with (a) polynucleotide(s) which is (are) adapted to the codon usage of the recombinant microorganism using codon pair optimisation technology which is well known to those skilled in the art. Codon-pair optimisation is a method for producing a polypeptide in a recombinant microorganism, wherein the polynucleotides encoding the polypeptide have been modified with respect to their codon-usage, in particular the codon-pairs that are used, to obtain improved expression of the polynucleotide encoding the polypeptide and/or improved production of the polypeptide. Codon pairs are defined as a set of two subsequent triplets (codons) in a coding sequence.

Further improvement of the activity of the enzymes in vivo in a recombinant microorganism as disclosed herein, can be obtained by well-known methods like error prone PCR or directed evolution. An exemplary method of directed evolution is described in WO03010183 and WO03010311.

As used herein, the term "marker" refers to a gene encoding a trait or a phenotype which permits the selection of, or the screening for, a recombinant microorganism containing the marker. The marker gene may be an antibiotic resistance gene whereby the appropriate antibiotic can be used to select for transformed cells from among cells that are not transformed. Alternatively or also, non-antibiotic resistance markers are used, such as auxotrophic markers (URA3, TRP1, LEU2). The recombinant microorganism transformed with the polynucleotide constructs may be marker gene free. Methods for constructing recombinant marker gene free recombinant microorganisms are disclosed in EP-A-0 635 574 and are based on the use of bidirectional markers. Alternatively, a screenable marker such as Green Fluorescent Protein, lacZ, luciferase, chloramphenicol acetyltransferase, beta-glucuronidase may be incorporated into the polynucleotide constructs as disclosed herein allowing to screen for transformed cells. An exemplary marker-free method for the introduction of heterologous polynucleotides is described in WO0540186.

As used herein, the term "operably linked" refers to a linkage of polynucleotide elements (comprising e.g. a coding sequence or another polynucleotide sequence) in a functional relationship. A polynucleotide is "operably linked" when it is placed into a functional relationship with another polynucleotide. For instance, a promoter sequence or enhancer sequence is operably linked to a coding sequence if it affects the transcription of the coding sequence.

As used herein, the term "promoter" refers to a polynucleotide fragment that functions to control the transcription of one or more genes, located upstream with respect to the direction of transcription of the transcription initiation site of the gene, and is structurally identified by the presence of a binding site for DNA-dependent RNA polymerase, transcription initiation sites and any other polynucleotide fragments, including, but not limited to transcription factor binding sites, repressor and activator protein binding sites, and any other sequences of nucleotides known to one of skilled in the art to act directly or indirectly to regulate the amount of transcription from the promoter. A "constitutive" promoter is a promoter that is active under most environmental and developmental conditions. An "inducible" promoter is a promoter that is active under environmental or developmental regulation.

The term "homologous" when used to indicate the relation between a given (recombinant) polynucleotide or polypeptide and a given host organism or host cell such as the recombinant microorganism as disclosed herein, is understood to mean that in nature the polynucleotide or polypeptide molecule is produced by a recombinant microorganism host cell or organism of the same species, such as of the same variety or strain.

The term "heterologous" when used with respect to a polynucleotide (DNA or RNA), polypeptide or protein refers to a polynucleotide, polypeptide or protein that does not occur naturally as part of the recombinant microorganism organism, cell, genome or DNA or RNA in which it is present, or that is found in a different number of copies or in a cell or location or locations in the genome or DNA or RNA that differ from that in which it is found in nature. Heterologous polynucleotides, polypeptides or proteins are not endogenous to the cell into which it is introduced, but have been obtained from another cell or synthetically or recombinantly produced.

The term "derived from" also includes the terms "originates from," "obtained from," "obtainable from," "isolated from," and "created from," and typically indicates that one specified material finds its origin in another specified material or has features that can be described with reference to another specified material. As used herein, a substance (e.g., a nucleic acid molecule or polypeptide) "derived from" a microorganism preferably means that the substance is native to that microorganism.

Detailed Description

Provided is a recombinant microorganism comprising, preferably expressing, one or more polynucleotide(s) encoding one or more polypeptide(s) having uridine diphosphate-dependent glycosyltransferase (UGT) activity, wherein said recombinant microorganism has a deficiency in a serine/threonine protein kinase polypeptide. In particular, said recombinant microorganism has a deficiency in a PSK1 polypeptide and/or a PSK2 polypeptide. More in particular, said recombinant microorganism has a deficiency in a PSK1.

The deficiency in a serine/threonine protein kinase in a recombinant microorganism is typically the result of a modification in its genome. Accordingly, the recombinant microorganism of the invention may comprise a genetic modification in its genome resulting in the deficiency of a serine/threonine protein kinase. In particular, said recombinant microorganism may comprise a genetic modification in its genome resulting in the deficiency of a PSK1 and/or PSK2. More in particular, said recombinant microorganism may comprise a genetic modification in its genome resulting in the deficiency of a PSK1.

PSK1, as well as its paralog PSK2, is annotated as a serine/threonine-protein kinase involved in the control of sugar metabolism and translation.

In some embodiments, in a recombinant microorganism as disclosed herein, the deficiency in the production of a serine/threonine protein kinase (e.g. PSK1 and/or PSK2) is a reduction in production of at least 20%, such as by at least 30%, such as by at least 40%, such as by at least 50%, such as at least 60%, such as at least 70%, such as at least 80%, such as by at least 85%, such as by at least 90%, such as by at least 95%, such as by 100% as compared to a corresponding microorganism that has no deficiency in said PSK (e.g. PSK1 and/or PSK2) when analysed under substantially identical conditions.

In some embodiments, in a recombinant microorganism as disclosed herein, the deficiency in the expression level of the mRNA transcribed from a gene encoding a serine/threonine protein kinase PSK (e.g. PSK1 and/or PSK2) is a reduction in expression of at least 20%, such as by at least 30%, such as by at least 40%, such as by at least 50%, such as at least 60%, such as at least 70%, such as at least 80%, such as by at least 85%, such as by at least 90%, such as by at least 95%, such as by 100% as compared to a corresponding microorganism that has no deficiency in said PSK (e.g. PSK1 and/or PSK2) when analysed under substantially identical conditions.

In some embodiments, in a recombinant microorganism as disclosed herein, the deficiency in the activity of a serine/threonine protein kinase PSK (e.g. PSK1 and/or PSK2) is a reduction in activity of at least 20%, such as by at least 30%, such as by at least 40%, such as by at least 50%, such as at least 60%, such as at least 70%, such as at least 80%, such as by at least 85%, such as by at least 90%, such as by at least 95%, such as by 100% as compared to a corresponding microorganism that has no deficiency in said PSK (e.g. PSK1 and/or PSK2) when analysed under substantially identical conditions.

A deficiency in a serine/threonine protein kinase, in particular PSK1 and/or PSK2, in a microorganism producing a steviol glycoside leads to higher production of the steviol glycoside as compared to a corresponding microorganism which has no deficiency of said PSK when analysed under substantially identical conditions.

In some embodiments, the recombinant microorganism as disclosed herein has a deficiency of a serine/threonine protein kinase wherein said PSK comprises or consists of a polypeptide having at least about 30% sequence identity with SEQ ID NO: 26, such as at least 35% identity, such as at least 40% identity, such as at least 45% identity, such as at least 50% identity, such as at least 55% identity, such as at least 60% identity, such as at least 65% identity, such as at least 70% identity, such as at least 75% identity, such as at least 80% identity, such as at least 85% identity, such as at least 90% identity, such as at least 91% identity, such as at least 92% identity, such as at least 93% identity, such as at least 94% identity, such as at least 95% identity, such as at least 96% identity, such as at least 97% identity, such as at least 98% identity, such as at least 99% identity, or such as 100% sequence identity with a PSK polypeptide with an amino acid sequence as set forward in SEQ ID NO: 26.

In some embodiments, the deficiency is the result of a modification in a mRNA or in a polynucleotide encoding the serine/threonine protein kinase polypeptide.

In some embodiments, a recombinant microorganism as disclosed herein may comprise, preferably express:

(a) a polynucleotide encoding a functional UGT1 polypeptide,
(b) a polynucleotide encoding a functional UGT3 polypeptide,
(c) a polynucleotide encoding a functional UGT4 polypeptide,
(d) a polynucleotide encoding a first functional UGT2 polypeptide, and/or
(e) a polynucleotide encoding a second functional UGT2 polypeptide.

In one embodiment, the second functional UGT2 polypeptide has the ability of beta 1,2 glycosylation of the C2' of the 19-O-glucose in stevioside and/or rubusoside; and/or said second functional UGT2 polypeptide has the ability to convert rebaudioside A to rebaudioside D at a rate that is faster than the rate at which the first functional UGT2 polypeptide convert rebaudioside A to rebaudioside D when the reactions are performed under corresponding conditions; and/or said second functional UGT2 polypeptide has the ability to convert higher amounts of rebaudioside A to rebaudioside D if compared with said first functional UGT2 polypeptide when the reactions are performed under corresponding conditions.

Herein, a polypeptide having UGT activity is to be construed as a polypeptide which has glycosyltransferase activity (EC 2.4), i.e. that can catalyze the transfer of a monosaccharide unit from an activated nucleotide sugar (also known as the "glycosyl donor") to a glycosyl acceptor molecule, usually an alcohol. The glycosyl donor for a UGT is typically the nucleotide sugar uridine diphosphate glucose (uracil-diphosphate glucose, UDP-glucose).

In some embodiments a polypeptide having UGT activity can also be construed as a polypeptide which has glycosyltransferase activity as herein defined but which is able to use glycosyl donors other than UDP-glucose, such as a NDP-glucose (i.e. nucleoside diphosphate glucose). In some embodiment the glycosyl donor is adenine diphosphate glucose (ADP-glucose). Examples of engineered glycosyltransferases able to use NDP-glucose as glycosyl donors are for example described in WO2018/144675, which is herein incorporated by reference in its entirety.

The UGTs used may be selected so as to produce a desired steviol glycoside, such as rebaudioside A, D or M. Schematic diagrams of steviol glycoside formation are set out in Humphrey et al., Plant Molecular Biology (2006) 61: 47-62 and Mohamed et al., J. Plant Physiology 168 (2011) 1136-1141, and in Olsson et al., *Microb. Cell Fact*. (2016) 15:207, DOI 10.1186/s12934-016-0609-1. In addition, FIG. 1 sets out a schematic diagram of steviol glycoside formation. As an example, in FIG. 1, the biosynthesis of rebaudioside A involves glucosylation of the aglycone steviol; or specifically, rebaudioside A can be formed by glucosylation of the 13-OH of steviol which forms the 13-O-steviolmonoside, glucosylation of the C-2' of the 13-O-glucose of steviolmonoside which forms steviol-1,2-bioside, glucosylation of the C-19 carboxyl of steviol-1,2-bioside which forms stevioside, and glucosylation of the C-3' of the C-13-O-glucose of stevioside. The order in which glucosylation reactions occurs can vary. Non-limiting examples of UGTs enzymes are set out in Table 1.

Herein, UGT1 activity preferably is transfer of a glucose unit to the 13-OH of a steviol backbone. Therefore, a UGT1 polypeptide is capable of glycosylating steviol or a precursor steviol glycoside at a C-13 hydroxyl group present in said steviol or precursor steviol glycoside, preferably wherein the glycosylation is a beta-glycosylation.

A suitable UGT1 polypeptide may function e.g. as a uridine 5'-diphospho glucosyl: steviol 13-OH transferase, and a uridine 5'-diphospho glucosyl: steviol-19-O-glucoside 13-OH transferase.

UGT1 polypeptides may also catalyze glucosyl transferase reactions that utilize steviol glucoside substrates other than steviol and steviol-19-O-glucoside, as long as the substrate has a steviol backbone with a free hydroxyl group at the C13 of the steviol moiety.

Exemplary, non-limiting reactions of UGT1 include:

conversion of steviol and UDP-glucose to steviol-13-O-glucoside, and conversion of steviol-19-O-glucoside and UDP-glucose to rubusoside.

Accordingly, in some embodiments a recombinant microorganism as disclosed herein may be capable of converting steviol and UDP-glucose into steviol-13-O-glucoside. In some embodiments a recombinant microorganism as disclosed herein may be capable of converting steviol-19-O-glucoside and UDP-glucose into rubusoside. Non-limiting examples of UGT1 polypeptides which can be used in the recombinant microorganism according to the disclosure are for example given in SEQ ID NO: 151, 152, 153 herewith, in SEQ ID NO: 72 of WO2014/191581A2, or polypeptide UGT85C corresponding to SEQ ID NO: 3 of WO2011/153378 A1, or polypeptide with an amino acid sequence that has at least about 20%, such as at least 25, 30, 40, 50, 55, 60, 65, 70, 75, 80, 85, 90, 95, 96, 97, 98, or 99%, sequence identity with the amino acid sequence SEQ ID NO: 151, 152, 153 herewith, SEQ ID NO: 72 of WO2014/191581A2, or SEQ ID NO: 3 of WO2011/153378 A1.

Herein, UGT2 activity preferably is transfer of a glucose unit to the C-2' position of a glucose linked through a glycosidic bond to the C13-hydroxyl or the C19-hydroxyl group or both of a steviol glycoside. Therefore, a polypeptide with UGT2 activity is a polypeptide capable of beta 1,2 glycosylation of the C2' of the 13-O-glucose, of the 19-O-glucose or both the 13-O-glucose and the 19-O-glucose of a precursor steviol glycoside having a 13-O-glucose, a 19-O-glucose, or both a 13-O-glucose and the 19-O-glucose.

A suitable UGT2 polypeptide may function e.g. as a uridine 5'-diphospho glucosyl: steviol-13-O-glucoside C-2' glucosyl transferase and a uridine 5'-diphospho glucosyl: rubusoside C-2' glucosyl transferase. UGT2 polypeptides may also catalyze glucosyl transferase reactions that utilize steviol glucoside substrates other than steviol-13-O-glucoside and rubusoside as long as the substrate has a steviol backbone.

Exemplary, non-limiting reactions of UGT2 polypeptides are:

- conversion of steviol 13-O-glucoside and UDP-glucose to steviol-1,2-bioside,
- conversion of rubusoside and UDP-glucose to stevioside,
- conversion of stevioside and UDP-glucose to rebaudioside E,
- conversion of rebaudioside A and UDP-glucose to rebaudioside D.

Accordingly, in some embodiments, a recombinant microorganism as disclosed herein may be capable of converting steviol 13-O-glucoside and UDP-glucose into steviol-1,2-bioside. In some embodiments a recombinant microorganism as disclosed herein may be capable of converting rubusoside and UDP-glucose into stevioside. In some embodiments a recombinant microorganism as disclosed herein may be capable of converting stevioside and UDP-glucose into rebaudioside E. In some embodiments a recombinant microorganism as disclosed herein may be capable of converting rebaudioside A and UDP-glucose into rebaudioside D. Non-limiting examples of UGT2 polypeptides which can be used in the recombinant microorganism according to the disclosure are for example those in SEQ ID NO: 160, 161, 162, 163, 164, 165, 166, or 167 herewith, UGT2_1a polypeptide according to SEQ ID NO: 88 of WO2014/191581 A2, UGT91 D2 polypeptide according to SEQ ID NO: 5 of WO2011/153378 A1 or EUGT11 polypeptide according to SEQ ID NO: 152 of WO2013/022989 A2, the polypeptide according to SEQ ID NO: 1, 2, 3, 4, of WO2016/151046 A1, the polypeptide according to SEQ ID NO: 1, 3, 6, 9, 11, 14, 17, 20, 22, 25 of WO2016/146711 A1. Alternatively said UGT2 polypeptide may have an amino acid sequence that has at least about 20%, such as at least 25, 30, 40, 50, 55, 60, 65, 70, 75, 80, 85, 90, 95, 96, 97, 98, or 99%, sequence identity with the amino acid sequence respectively of SEQ ID NO: 160, 161, 162, 163, 164, 165, 166, or 167 herewith, SEQ ID NO: 88 of WO2014/191581 A2, SEQ ID NO: 5 of WO2011/153378 A1, SEQ ID NO: 152 of WO2013/022989 A2, SEQ ID NO: 1, 2, 3, 4, of WO2016/151046 A1, SEQ ID NO: 1, 3, 6, 9, 11, 14, 17, 20, 22, 25 of WO2016/146711 A1.

Herein, UGT3 activity preferably is transfer of a glucose unit to the 19-COOH of a steviol backbone. Therefore, a polypeptide with UGT3 activity is a polypeptide capable of glycosylating steviol or a precursor steviol glycoside at a C-19 carboxyl group present in said steviol or precursor steviol glycoside, preferably wherein the glycosylation is a beta-glycosylation.

A suitable UGT3 polypeptide may function e.g. as a uridine 5'-diphospho glucosyl: steviol 19-COOH transferase and a uridine 5'-diphospho glucosyl: steviol-13-O-glucoside 19-COOH transferase.

UGT3 polypeptides may also catalyze glucosyl transferase reactions that utilize steviol glucoside substrates other than steviol and steviol-13-O-glucoside, as long as the substrate has a steviol backbone.

Exemplary, non-limiting reactions of UGT3 include:

- conversion of steviol and UDP-glucose to steviol-19-O-glucoside,
- conversion of steviol-13-O-glucoside and UDP-glucose to rubusoside,
- conversion of steviol-1,3-bioside and UDP-glucose to 1,3-stevioside (rebaudioside G),
- conversion of steviol-1,2-bioside and UDP-glucose to stevioside, and
- conversion of rebaudioside B and UDP-glucose to rebaudioside A.

Accordingly, in some embodiments a recombinant microorganism as disclosed herein may be capable of converting steviol and UDP-glucose into steviol-19-O-glucoside. In some embodiments a recombinant microorganism as disclosed herein may be capable of converting steviol-13-O-glucoside and UDP-glucose into rubusoside. In some embodiments a recombinant microorganism as disclosed herein may be capable of converting of steviol-1,3-bioside and UDP-glucose into 1,3-stevioside (rebaudioside G). In some embodiments a recombinant microorganism as disclosed herein may be capable of converting steviol-1,2-bioside and UDP-glucose into Stevioside. In some embodiments a recombinant microorganism as disclosed herein may be capable of converting rebaudioside B and UDP-glucose into rebaudioside A. Non-limiting examples of UGT3 polypeptides which can be used in the recombinant microorganism according to the disclosure are for example polypeptide according to SEQ ID NOs: 177, 178, 179, 180, 181 or 182 herewith, SEQ ID NO: 74 of WO2014/191581 A2, the UGT74G1 polypeptide according to SEQ ID NO: 19 of WO2014/122227 A2, or polypeptides according to SEQ ID NO: 4, 6, 8, 10, 12, 14, 16, 18 or 20 of WO2019/002264 A1. Alternatively said UGT3 polypeptide may have an amino acid sequence that has at least about 20%, such as at least 25, 30, 40, 50, 55, 60, 65, 70, 75, 80, 85, 90, 95, 96, 97, 98, or 99%, sequence identity with the amino acid sequence respectively of SEQ ID NOs: 177, 178, 179, 180, 181 or 182 herewith, SEQ ID NO: 74 of WO2014/191581 A2, SEQ ID NO: 19 of WO2014/122227 A2, SEQ ID NO: 4, 6, 8, 10, 12, 14, 16, 18 or 20 of WO2019/002264 A1.

Herein, UGT4 activity preferably is transfer of a glucose unit to the C-3' position of the glucose at the 13-OH or the 19-COOH position of a steviol. A UGT4 polypeptide Is capable of beta 1,3 glycosylation of the C3' of a 13-O-glucose, of a 19-O-glucose or both the 13-O-glucose and the 19-O-glucose of a precursor steviol glycoside having a 13-O-glucose, a 19-O-glucose, or both a 13-O-glucose and a 19-O-glucose. A suitable UGT4 polypeptide may function e.g. as a uridine 5'-diphospho glucosyl: steviol 13-O-glucoside C-3' glucosyl transferase and a uridine 5'-diphospho glucosyl: steviol 1,2 bioside C-3' glucosyl transferase. UGT4 polypeptides may also catalyze glucosyl transferase reactions that utilize steviol glucoside substrates other than steviol glycoside and steviol di-glycoside as long as the substrate has a steviol backbone.

Exemplary, non-limiting reactions of UGT4 include:

conversion of steviol-13-O-glucoside and UDP-glucose to steviol 1,3 bioside, conversion of steviol 1,2 bioside and UDP-glucose to rebaudioside B, conversion of rubusoside and UDP-glucose to 1,3 stevioside, conversion of 1,3 stevioside and UDP-glucose to rebaudioside Q, conversion of stevioside and UDP-glucose to rebaudioside A, conversion of rebaudioside A and UDP-glucose to rebaudioside I, conversion of rebaudioside E and UDP-glucose to rebaudioside D, and conversion of rebaudioside D and UDP-glucose to rebaudioside M.

Accordingly, in some embodiments a recombinant microorganism as disclosed herein may be capable of converting steviol-13-O-glucoside and UDP-glucose into steviol 1,3 bioside. In some embodiments a recombinant microorganism as disclosed herein may be capable of converting steviol 1,2 bioside and UDP-glucose into rebaudioside B. In some embodiments a recombinant microorganism as disclosed herein may be capable of converting rubusoside and UDP-glucose in to 1,3 stevioside. In some embodiments a recombinant microorganism as disclosed herein may be capable of converting 1,3 stevioside and UDP-glucose into rebaudioside Q. In some embodiments a recombinant microorganism as disclosed herein may be capable of converting stevioside and UDP-glucose into rebaudioside A. In some embodiments a recombinant microorganism as disclosed herein may be capable of converting rebaudioside A and UDP-glucose into rebaudioside 1. In some embodiments a recombinant microorganism as disclosed herein may be capable of converting rebaudioside E and UDP-glucose into rebaudioside D. In some embodiments a recombinant microorganism as disclosed herein may be capable of converting rebaudioside D and UDP-glucose into rebaudioside M. A. Non-limiting examples of UGT4 polypeptides which can be used in the recombinant microorganism according to the disclosure are for example polypeptide according to SEQ ID NOs: 195, 196 or 197 herewith, SEQ ID NO: 50, 52 of WO2014/191581 A2, the UGT76G polypeptide according to SEQ ID NO: 7 of WO2011/153378 A1. Alternatively said UGT polypeptide may have an amino acid sequence that has at least about 20%, such as at least 25, 30, 40, 50, 55, 60, 65, 70, 75, 80, 85, 90, 95, 96, 97, 98, or 99%, sequence identity with the amino acid sequence respectively of SEQ ID NOs: 195, 196 or 197 herewith, SEQ ID NO: 50, 52 of WO2014/191581 A2, SEQ ID NO: 7 of WO2011/153378 A1.

In some embodiments, a recombinant microorganism as disclosed herein may comprise, preferably express:

(a) a polynucleotide encoding an UGT1 polypeptide, wherein said UGT1 polypeptide is capable of beta glycosylating steviol or a precursor steviol glycoside at a C-13 hydroxyl group present in said steviol or precursor steviol glycoside, preferably a UGT1 polypeptide having at least uridine 5'-diphosphoglucosyl:steviol 13-OH transferase and/or uridine 5'-diphosphoglucosyl:steviol-19-O-glucoside 13-OH transferase activity, such as a UGT85C2 polypeptide;

(b) a polynucleotide encoding a UGT3 polypeptide, wherein said UGT3 polypeptide is capable of beta glycosylating steviol or a precursor steviol glycoside at a C-19 carboxyl group present in said steviol or precursor steviol glycoside, preferably a UGT3 polypeptide having at least uridine 5'-diphosphoglucosyl: steviol 19-COOH transferase and/or uridine 5'-diphosphoglucosyl: steviol-13-O-glucoside 19-COOH transferase activity, such as a UGT74G1 polypeptide;

(c) a polynucleotide encoding a UGT4 polypeptide catalysing at least glycosylation of steviol and steviol glycosides at the 19-0 position and/or at the 13-0 position, such as a UGT76G1 polypeptide, (d) a polynucleotide encoding a first UGT2 polypeptide, wherein said UGT2 polypeptide is capable of beta 1,2 glycosylation of the C2' of the 13-O-glucose, of the 19-O-glucose or both the 13-O-glucose and the 19-O-glucose of a precursor steviol glycoside having a 13-O-glucose, a 19-O-glucose, or both the 13-O-glucose and the 19-O-glucose, preferably a UGT2 polypeptide having at least uridine 5'-diphospho glucosyl: steviol-13-O-glucoside transferase activity, such as a UGT91d2 polypeptide, and/or (e) a polynucleotide encoding a second UGT2 polypeptide, wherein said second UGT2 polypeptide has the ability to convert rebaudioside A to rebaudioside D at a rate that is faster than the rate at which the first functional UGT2 polypeptide convert rebaudioside A to rebaudioside D when the reactions are performed under corresponding conditions; and/or said second functional UGT2 polypeptide has the ability to convert higher amounts of rebaudioside A to rebaudioside D if compared with said first functional UGT2 polypeptide when the reactions are performed under corresponding conditions, preferably a EUGT11 polypeptide;

wherein the microorganism produces a steviol glycoside, such as: steviol-13-O-glucoside, steviol-19-O-glucoside, steviol-1,2-bioside, steviol-1,3-bioside, stevioside, rebaudioside A, rebaudioside B, rebaudioside C, rebaudioside D, rebaudioside E, rebaudioside F, rebaudioside I, rebaudioside Q, rebaudioside M, rubusoside, and/or dulcoside A, preferably at least Rebaudioside D, and/or Rebaudioside M.

In some embodiments, a recombinant microorganism as disclosed herein is capable of expressing, preferably expressing, a polynucleotide encoding a UGT1 polypeptide selected from the group consisting of:

i. a polynucleotide encoding a polypeptide comprising an amino acid sequence that has at least about 20%, such as at least 25, 30, 40, 50, 55, 60, 65, 70, 75, 80, 85, 90, 95, 96, 97, 98, 99%, or 100% sequence identity with the amino acid sequence of SEQ ID NOs: 151, 152 or 153;

ii. a polynucleotide that has at least about 15%, such as at least 20, 25, 30, 40, 50, 55, 60, 65, 70, 75, 80, 85, 90, 95, 96, 97, 98, 99%, or 100% sequence identity with the polynucleotide of SEQ ID NOs: 154, 155, 156, 157, 158, 159, 36;

iii. a polynucleotide the complementary strand of which hybridizes to a polynucleotide of (i) or (ii); or iv. a polynucleotide which differs from the sequence of a polynucleotide of (i), (ii) or (iii) due to the degeneracy of the genetic code.

In some embodiments, a recombinant microorganism as disclosed herein is capable of expressing, preferably expressing, a polynucleotide encoding a UGT2 polypeptide selected from the group consisting of:

i. a polynucleotide encoding a polypeptide comprising an amino acid sequence that has at least about 20%, such as at least 25, 30, 40, 50, 55, 60, 65, 70, 75, 80, 85, 90, 95, 96, 97, 98, 99%, or 100%, sequence identity with the amino acid sequence of SEQ ID NOs: 160, 161, 162, 163, 164, 165, 166, or 167;

ii. a polynucleotide that has at least about 15%, such as at least 20, 25, 30, 40, 50, 55, 60, 65, 70, 75, 80, 85, 90, 95, 96, 97, 98, 99%, or 100%, sequence identity with the polynucleotide of SEQ ID NOs: 166, 169, 170, 171, 172, 173, 174, 175, 176 or 37;

iii. a polynucleotide the complementary strand of which hybridizes to a polynucleotide of (i) or (ii); or iv. a polynucleotide which differs from the sequence of a polynucleotide of (i), (ii) or (iii) due to the degeneracy of the genetic code.

In some embodiments, a recombinant microorganism as disclosed herein is capable of expressing, preferably expressing, a polynucleotide encoding a UGT3 polypeptide selected from the group consisting of:

i. a polynucleotide encoding a polypeptide comprising an amino acid sequence that has at least about 20%, 25, 30, 40, 50, 55, 60, 65, 70, 75, 80, 85, 90, 95, 96, 97, 98, 99%, or 100% sequence identity with the amino acid sequence of SEQ ID NOs: 177, 178, 179, 180, 181 or 182;

ii. a polynucleotide that has at least about 15%, 20, 25, 30, 40, 50, 55, 60, 65, 70, 75, 80, 85, 90, 95, 96, 97, 98, 99%, or 100% sequence identity with the polynucleotide of SEQ ID NOs: 183, 184, 185, 186, 187, 188, 189, 190, 191, 192, 193, 194 or 38;

iii. a polynucleotide the complementary strand of which hybridizes to a polynucleotide of (i) or (ii); or iv. a polynucleotide which differs from the sequence of a polynucleotide of (i), (ii) or (iii) due to the degeneracy of the genetic code.

In some embodiments, a recombinant microorganism as disclosed herein is capable of expressing, preferably expressing, a polynucleotide encoding a UGT4 polypeptide selected from the group consisting of:

i. a polynucleotide encoding a polypeptide comprising an amino acid sequence that has at least about 20%, such as at least 25, 30, 40, 50, 55, 60, 65, 70, 75, 80, 85, 90, 95, 96, 97, 98, 99%, or 100%, sequence identity with the amino acid sequence of SEQ ID NOs: 195, 196 or 197;

ii. a polynucleotide that has at least about 15%, such as at least 20, 25, 30, 40, 50, 55, 60, 65, 70, 75, 80, 85, 90, 95, 96, 97, 98, 99%, or 100%, sequence identity with the polynucleotide of SEQ ID NOs: 38, 199, 200, 201, 202, 203 or 39;

iii. a polynucleotide the complementary strand of which hybridizes to a polynucleotide of (i) or (ii); or iv. a polynucleotide which differs from the sequence of a polynucleotide of (i), (ii) or (iii) due to the degeneracy of the genetic code.

If a recombinant microorganism as disclosed herein is not capable of producing steviol as an intermediate product for the steviol glycosides disclosed herein, one or more of the enzyme required for the production of steviol from geranyl-geranyl pyrophosphate (GGPP).

Accordingly, in some embodiments a recombinant microorganism as disclosed herein may additionally comprise, preferably express:

(f) a polynucleotide encoding a geranyl-geranyl pyrophosphate synthase (GGPPS), (g) a polynucleotide encoding an ent-copalyl pyrophosphate synthase (CDPS), (h) a polynucleotide encoding a kaurene oxidase (KO), (i) a polynucleotide encoding a kaurene synthase (KS), and/or (j) a polynucleotide encoding a kaurenoic acid 13-hydroxylase (KAH);

wherein the microorganism produces a steviol glycoside, such as: steviol-13-O-glucoside, steviol-19-O-glucoside, steviol-1,2-bioside, steviol-1,3-bioside, stevioside, rebaudioside A, rebaudioside B, rebaudioside C, rebaudioside D, rebaudioside E, rebaudioside F, rebaudioside I, rebaudioside Q, rebaudioside M, rubusoside, and/or dulcoside A, preferably at least Rebaudioside D, and/or Rebaudioside M.

In some embodiments, a recombinant microorganism as disclosed herein may additionally comprise, preferably express, a polynucleotide encoding a geranyl-geranyl pyrophosphate synthase (GGPPS). Such GGPPS may be any suitable GGPPS known to the person skilled in the art and may e.g. be from prokaryotic or eukaryotic origin. Such a polynucleotide encoding a GGPPS may comprise:

i. a polynucleotide encoding a polypeptide having geranylgeranyl diphosphate synthase activity, said polypeptide comprising an amino acid sequence that has at least about 20%, such as at least 25, 30, 40, 50, 55, 60, 65, 70, 75, 80, 85, 90, 95, 96, 97, 98, 99%, or 100%, sequence identity with the amino acid sequence of SEQ ID NO: 208 herewith; SEQ ID Nos: 121-128 of WO2011/53378 A1, or SEQ ID NO: 1 of WO2016/170045 A1.

ii. a polynucleotide that has at least about 15% sequence identity with the polynucleotide of SEQ ID NOs: 209;

iii. a polynucleotide the complementary strand of which hybridizes to a polynucleotide of (i) or (ii); or iv. a polynucleotide which differs from a polynucleotide of (i), (ii) or (iii) due to the degeneracy of the genetic code.

In some embodiments, a recombinant microorganism as disclosed herein may additionally comprise, preferably express, a polynucleotide encoding an ent-copalyl pyrophosphate synthase (CDPS). Such CDPS may be any suitable CDPS known to the person skilled in the art and may e.g. be from prokaryotic or eukaryotic origin. Such a polynucleotide encoding a CDPS may comprise:

i. a polynucleotide encoding a polypeptide having ent-copalyl pyrophosphate synthase activity, said polypeptide comprising an amino acid sequence that has at least about 20%, such as at least 25, 30, 40, 50, 55, 60, 65, 70, 75, 80, 85, 90, 95, 96, 97, 98, 99% or 100%, sequence identity with the amino acid sequence of SEQ ID NOs: 61, 62, 63, 64, 65, 66, 67 or 68 herewith or SEQ ID Nos: 129-131 of WO2011/53378 A1, SEQ ID Nos: 158, 160 of WO2013/022989 A2;

ii. a polynucleotide that has at least about 15%, such as at least 20, 25, 30, 40, 50, 55, 60, 65, 70, 75, 80, 85, 90, 95, 96, 97, 98, 99% or 100%, sequence identity with the polynucleotide of SEQ ID NOs: 69, 70, 71, 72, 73, 74, 75, 76, 77, 78, 79, 80, 81, 82, 83, 84, 29 or 85;

iii. a polynucleotide the complementary strand of which hybridizes to a polynucleotide of (i) or (ii); or iv. a polynucleotide which differs from a polynucleotide of (i), (ii) or (iii) due to the degeneracy of the genetic code.

An exemplary ent-copalyl pyrophosphate synthase is the polypeptide encoded by the polynucleotide set out in SEQ ID NO: 29.

Herein, a polypeptide having ent-copalyl pyrophosphate synthase (EC 5.5.1.13) is to be construed as capable of catalyzing the chemical reaction:

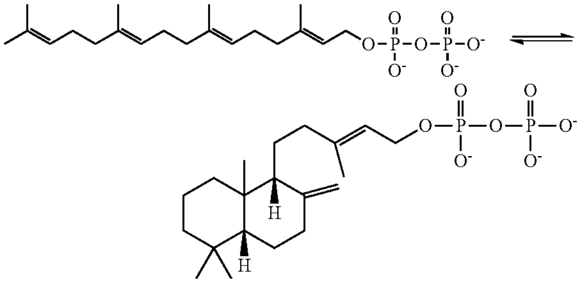

This enzyme has one substrate, geranylgeranyl pyrophosphate, and one product, ent-copalyl pyrophosphate. This enzyme participates in gibberellin biosynthesis. This enzyme belongs to the family of isomerase, specifically the class of intramolecular lyases. The systematic name of this enzyme class is ent-copalyl-diphosphate lyase (decyclizing). Other names in common use include having ent-copalyl pyrophosphate synthase, ent-kaurene synthase A, and ent-kaurene synthetase A.

In some embodiments, a recombinant microorganism as disclosed herein may additionally comprise, preferably express, a polynucleotide encoding a kaurene oxidase (KO). Such KO may be any suitable KO known to the person skilled in the art and may e.g. be from prokaryotic or eukaryotic origin. Such a polynucleotide encoding a KO may comprise:

i. a polynucleotide encoding a polypeptide having ent-Kaurene oxidase activity, said polypeptide comprising an amino acid sequence that has at least about 20%, such as at least 25, 30, 40, 50, 55, 60, 65, 70, 75, 80, 85, 90, 95, 96, 97, 98, 99% or 100% sequence identity with the amino acid sequence of SEQ ID NOs: 111, 112, 113, 114 or 115 herewith, or SEQ ID Nos: 138-141 of WO2011/53378 A1;

ii. a polynucleotide that has at least about 15%, such as at least 20, 25, 30, 40, 50, 55, 60, 65, 70, 75, 80, 85, 90, 95, 96, 97, 98, 99% or 100% sequence identity with the polynucleotide of SEQ ID NOs: 116, 117, 118, 119, 120, 121, 122, 123, 124, 125 or 32;

iii. a polynucleotide the complementary strand of which hybridizes to a polynucleotide of (i) or (ii); or iv. a polynucleotide which differs from a polynucleotide of (i), (ii) or (iii) due to the degeneracy of the genetic code.

An exemplary ent-Kaurene oxidase is the polypeptide encoded by the polynucleotide set out in SEQ ID NO: 120.

Herein, a polypeptide having ent-kaurene oxidase activity (EC 1.14.13.78) is to be construed as a polypeptide which is capable of catalysing three successive oxidations of the 4-methyl group of ent-kaurene to give kaurenoic acid. Such activity typically requires the presence of a cytochrome P450.

In some embodiments, a recombinant microorganism as disclosed herein may additionally comprise, preferably express, a polynucleotide encoding a kaurene synthase (KS). Such KS may be any suitable KS known to the person skilled in the art and may e.g. be from prokaryotic or eukaryotic origin. Such a polynucleotide encoding a KS may comprise:

i. a polynucleotide encoding a polypeptide having ent-Kaurene synthase activity, said polypeptide comprising an amino acid sequence that has at least about 20%, such as at least 25, 30, 40, 50, 55, 60, 65, 70, 75, 80, 85, 90, 95, 96, 97, 98, 99% or 100%, sequence identity with the amino acid sequence of SEQ ID NOs: 86, 87, 88, 89, 90, 91, 92 or 93 herewith, or SEQ ID Nos: 132-135 of WO2011/153378 A1, SEQ ID NO:156 of WO2013/022989 A2;

ii. a polynucleotide that has at least about 15%, such as at least 20, 25, 30, 40, 50, 55, 60, 65, 70, 75, 80, 85, 90, 95, 96, 97, 98, 99% or 100%, sequence identity with the polynucleotide of SEQ ID NOs: 94, 95, 96, 97, 98, 99, 100, 101, 102, 103, 104, 105, 106, 107, 108, 109, 30 or 110;

iii. a polynucleotide the complementary strand of which hybridizes to a polynucleotide of (i) or (ii); or iv. a polynucleotide which differs from a polynucleotide of (i), (ii) or (iii) due to the degeneracy of the genetic code.

An exemplary ent-Kaurene synthase is the polypeptide encoded by the polynucleotide set out in SEQ ID NO: 30.

Herein, a polypeptide having ent-kaurene synthase activity (EC 4.2.3.19) is to be construed as a polypeptide that is capable of catalyzing the chemical reaction:

ent-copalyl diphosphate ⇌ ent-kaurene+diphosphate

Hence, this enzyme has one substrate, ent-copalyl diphosphate, and two products, ent-kaurene and diphosphate.

This enzyme belongs to the family of lyases, specifically those carbon-oxygen lyases acting on phosphates. The systematic name of this enzyme class is ent-copalyl-diphosphate diphosphate-lyase (cyclizing, ent-kaurene-forming). Other names in common use include ent-kaurene synthase B, ent-kaurene synthetase B, ent-copalyl-diphosphate diphosphate-lyase, and (cyclizing). This enzyme participates in diterpenoid biosynthesis.

Ent-copalyl diphosphate synthases may also have a distinct ent-kaurene synthase activity associated with the same protein. The reaction catalyzed by ent-kaurene synthase is the next step in the biosynthetic pathway to gibberellins. The two types of enzymic activity are distinct, and site-directed mutagenesis to suppress the ent-kaurene synthase activity of the protein leads to build up of ent-copalyl pyrophosphate.

Accordingly, in the embodiments herein a single polynucleotide may encode a polypeptide having ent-copalyl pyrophosphate synthase activity and ent-kaurene synthase activity. Alternatively, the two activities may be encoded two distinct, separate polynucleotides.

In some embodiments, a recombinant microorganism as disclosed herein may additionally comprise, preferably express, a polynucleotide encoding a kaurenoic acid 13-hydroxylase (KAH). Such KAH may be any suitable KAH known to the person skilled in the art and may e.g. be from prokaryotic or eukaryotic origin. Such a polynucleotide encoding a KAH may comprise:

i. a polynucleotide encoding a polypeptide having kaurenoic acid 13-hydroxylase activity, said polypeptide comprising an amino acid sequence that has at least about 20%, such as at least 25, 30, 40, 50, 55, 60, 65, 70, 75, 80, 85, 90, 95, 96, 97, 98, 99% or 100%, sequence identity with the amino acid sequence of SEQ ID NOs: 126, 127, 128, 129, 130, 131, 132, 133, 134 or 135 herewith, or SEQ ID NOs: 142-146 of WO2011/

153378 A1, SEQ ID NO: 164 of WO2013/022989 A2, or SEQ ID NOs: 1, 5, 7, 9, 11, 13, 15, 17, 19, 21, 23, 25, 27, 29, 31, 33, 35 37 of WO2017/060318 A2 or SEQ ID NOs: 1, 3, 5, 7, 9, 11, 13 of WO2018/104238 A1;

ii. a polynucleotide that has at least about 15%, such as at least 20, 25, 30, 40, 50, 55, 60, 65, 70, 75, 80, 85, 90, 95, 96, 97, 98, 99% or 100%, sequence identity with the polynucleotide of SEQ ID NOs: 136, 137, 138, 139, 140, 141, 142, 143, 144, 145, 146, 147, 148, 149, 150 or 33;

iii. a polynucleotide the complementary strand of which hybridizes to a polynucleotide of (i) or (ii); or iv. a polynucleotide which differs from the sequence of a polynucleotide of (i), (ii) or (iii) due to the degeneracy of the genetic code.

An exemplary KAH is the polypeptide encoded by the polynucleotide set out in SEQ ID NO: 139.

Herein, a polypeptide having kaurenoic acid 13-hydroxylase activity (EC 1.14.13) is to be construed as a polypeptide which is capable of catalyzing the formation of steviol (ent-kaur-16-en-13-ol-19-oic acid) using NADPH and 02. Such activity may also be referred to as ent-kaurenoic acid 13-hydroxylase activity.

In some embodiments, a recombinant microorganism as disclosed herein may additionally comprise, preferably express, a polynucleotide encoding a cytochrome P450 reductase (CPR). Such CPR may be any suitable CPR known to the person skilled in the art, such as an NADPH-cytochrome p450 reductase, and may e.g. be from prokaryotic or eukaryotic origin. Such a polynucleotide encoding a CPR may comprise:

i. a polynucleotide encoding a polypeptide having NADPH-cytochrome p450 reductase activity, said polypeptide comprising an amino acid sequence that has at least about 20%, such as at least 25, 30, 40, 50, 55, 60, 65, 70, 75, 80, 85, 90, 95, 96, 97, 98, 99% or 100%, sequence identity with the amino acid sequence of SEQ ID NOs: 211, 213, 215 or 217 herewith or SEQ ID NOs: 147-149 of WO2011/153378 A1;

ii. a polynucleotide that has at least about 15%, such as at least 20, 25, 30, 40, 50, 55, 60, 65, 70, 75, 80, 85, 90, 95, 96, 97, 98, 99% or 100%, sequence identity with the polynucleotide of SEQ ID NOs: 35, 210, 212, 214 or 216;

iii. a polynucleotide the complementary strand of which hybridizes to a polynucleotide of (i) or (ii); or iv. a polynucleotide which differs from the polynucleotide of (i), (ii) or (iii) due to the degeneracy of the genetic code.

An exemplary CPR is the polypeptide encoded by the polynucleotide set out in SEQ ID NO: 35.

Herein, a polypeptide having NADPH-Cytochrome P450 reductase activity (EC 1.6.2.4; also known as NADPH: ferrihemoprotein oxidoreductase, NADPH:hemoprotein oxidoreductase, NADPH:P450 oxidoreductase, P450 reductase, POR, CPR, CYPOR) is typically one which is a membrane-bound enzyme allowing electron transfer to cytochrome P450 in the microsome of a eukaryotic cell from a FAD- and FMN-containing enzyme NADPH:cytochrome P450 reductase (POR; EC 1.6.2.4).

In some embodiments, in a recombinant microorganism as disclosed herein, the ability to produce geranylgeranyl diphosphate (GGPP) may be upregulated. In some of such embodiments, the recombinant microorganism may comprise, preferably express, one or more polynucleotide(s) encoding hydroxymethylglutaryl-CoA reductase, farnesyl-pyrophosphate synthetase and geranylgeranyl diphosphate synthase, whereby expression of the polynucleotide(s) confer(s) on the recombinant microorganism the ability to produce elevated levels of GGPP.

Such hydroxymethylglutaryl-CoA reductase may be any suitable hydroxymethylglutaryl-CoA reductase known to the person skilled in the art, and may e.g. be from prokaryotic or eukaryotic origin. Such a polynucleotide encoding a hydroxymethylglutaryl-CoA reductase may comprise:

i. a polynucleotide encoding a polypeptide having hydroxymethylglutaryl-CoA reductase activity, said polypeptide comprising an amino acid sequence that has at least about 20%, such as at least 25, 30, 40, 50, 55, 60, 65, 70, 75, 80, 85, 90, 95, 96, 97, 98, 99% or 100% sequence identity with the amino acid sequence of SEQ ID NO: 204 or SEQ ID NOs: 104, 106, 108, 110, 112, 114, 116, 118, 120 of WO2011/152278 A1;

ii. a polynucleotide that has at least about 15%, such as at least 20, 25, 30, 40, 50, 55, 60, 65, 70, 75, 80, 85, 90, 95, 96, 97, 98, 99% or 100% sequence identity with the polynucleotide of SEQ ID NO: 205;

iii. a polynucleotide the complementary strand of which hybridizes to a polynucleotide of (i) or (ii); or iv. a polynucleotide which differs from the sequence of a polynucleotide of (i), (ii) or (iii) due to the degeneracy of the genetic code.

An exemplary hydroxymethylglutaryl-CoA reductase is the polypeptide encoded by the polynucleotide set out in SEQ ID NO: 205.

Such farnesyl-pyrophosphate synthetase may be any suitable farnesyl-pyrophosphate synthetase known to the person skilled in the art, and may e.g. be from prokaryotic or eukaryotic origin. Such a polynucleotide encoding a farnesyl-pyrophosphate synthetase may comprise:

i. a polynucleotide encoding a polypeptide having farnesyl-pyrophosphate synthetase activity, said polypeptide comprising an amino acid sequence that has at least about 20%, such as at least 25, 30, 40, 50, 55, 60, 65, 70, 75, 80, 85, 90, 95, 96, 97, 98, 99% or 100% sequence identity with the amino acid sequence of SEQ ID NO: 206 herewith;

ii. a polynucleotide that has at least about 15%, such as at least 20, 25, 30, 40, 50, 55, 60, 65, 70, 75, 80, 85, 90, 95, 96, 97, 98, 99% or 100% sequence identity with the polynucleotide of SEQ ID NOs: 207;

iii. a polynucleotide the complementary strand of which hybridizes to a polynucleotide of (i) or (ii); or iv. a polynucleotide which differs from the sequence of a polynucleotide of (iii) due to the degeneracy of the genetic code.

An exemplary farnesyl-pyrophosphate synthetase is the polypeptide encoded by the polynucleotide set out in SEQ ID NO: 207.

Such geranylgeranyl diphosphate synthase may be any suitable geranylgeranyl diphosphate synthase known to the person skilled in the art, and may e.g. be from prokaryotic or eukaryotic origin. Such a polynucleotide encoding a geranylgeranyl diphosphate synthase may comprise:

i. a polynucleotide encoding a polypeptide having geranylgeranyl diphosphate synthase activity, said polypeptide comprising an amino acid sequence that has at least about 20%, such as at least 25, 30, 40, 50, 55, 60, 65, 70, 75, 80, 85, 90, 95, 96, 97, 98, 99% or 100% sequence identity with the amino acid sequence of SEQ ID NO: 208;

ii. a polynucleotide that has at least about 15%, such as at least 20, 25, 30, 40, 50, 55, 60, 65, 70, 75, 80, 85, 90, 95, 96, 97, 98, 99% or 100% sequence identity with the polynucleotide of SEQ ID NO: 209;

iii. a polynucleotide the complementary strand of which hybridizes to a polynucleotide of (i) or (ii); or iv. a polynucleotide which differs from a polynucleotide of (i), (ii) or (iii) due to the degeneracy of the genetic code.

An exemplary geranylgeranyl diphosphate synthase is the polypeptide encoded by the polynucleotide set out in SEQ ID NO: 209.

An exemplary recombinant microorganism as disclosed herein is a yeast such as a *Saccharomyces cerevisiae* or *Yarrowia lipolytica*. A recombinant microorganism as disclosed herein, such as a recombinant *Saccharomyces cerevisiae* cell or *Yarrowia lipolytica* cell may comprise one or more polynucleotide(s) from each of the following groups:

(i) SEQ ID NOs: 69, 70, 71, 72, 73, 74, 75, 76, 77, 78, 80, 81, 82, 83, 84, 29 or 110;

(ii) SEQ ID NOs: 94, 95, 96, 97, 98, 99, 100, 101, 102, 103, 104, 105, 106, 107, 108, 109, 30 or 110;

(iii) SEQ ID NOs: 116, 117, 118, 119, 120, 121, 122, 123, 124, 125 or 32; or (iv) SEQ ID NOs: 136, 137, 138, 139, 140, 141, 142, 143, 144, 145, 146, 147, 148, 149, 150 or 33.

Such a recombinant microorganism will typically also comprise one or more polynucleotide(s) as set out in SEQ ID NOs: 35, 210, 212, 214 or 216.

Such a recombinant microorganism may also comprise one or more polynucleotides as set out in SEQ ID NOs: 154, 155, 183, 184, 185, 186, 187, 38, 199, 156, 188, 200, 158, 159, 190, 191, 192, 193, 194, 202, 203, 157, 189, 201, 168, 176, 169, 161, 170, 162, 171, 163, 172, 164, 173, 165, 174, 166, 175, 167, 218, 219, 220, 221, 222, 223, 224, 225, 226, 227, 228, 229, 230, 231, 232, 233, 234, 235, 236, 237, 238, 239, 240, 241, 242, 243, 244, 245, 36, 247, 39 or 37. In the case of these polynucleotide, combinations of at least one from each of (i) SEQ ID NOs: 154, 155, 158, 159, 156, 157 or 36; (ii) SEQ ID NOs: 168, 169, 170, 171, 172, 173, 174, 175, 176 or 37; (iii) SEQ ID NOs: 183, 184, 185, 186, 187, 190, 191, 192, 193, 194, 188, 189 or 38; and (iv) SEQ ID NOs: 38, 199, 202, 203, 200, 201 or 39 may be used. Typically, at least one UGT from group (i) may be used. If at least one UGT from group (iii) is used, generally at least one UGT from group (i) is also used. If at least one UGT from group (iv) is used, generally at least one UGT from group (i) and at least one UGT from group (iii) is used. Typically, at least one UGT form group (ii) is used.

Such a recombinant microorganism may also comprise the following polynucleotides: SEQ ID. NO: 205; SEQ ID. NO: 207; and SEQ ID. NO: 209.

The recombinant organism as disclosed herein may be any microorganism as specified in the section General Definitions and elsewhere herein.

In some embodiments, the recombinant microorganism as disclosed herein belongs to one of the genera *Saccharomyces, Aspergillus, Pichia, Kluyveromyces, Candida, Hansenula, Humicola, Trichosporon, Brettanomyces, Pachysolen, Yarrowia, Yamadazyma* or *Escherichia*.

In some of such embodiments, the recombinant microorganism may be a *Saccharomyces cerevisiae* cell, a *Yarrowia lipolytica* cell or an *Escherichia coli* cell.

A recombinant microorganism as disclosed herein may be modified so that the ERG9 gene is down-regulated and or the ERG5/ERG6 genes are deleted. Corresponding genes may be modified in this way in other microorganisms.

Such a recombinant microorganism may be transformed as set out herein, whereby the polynucleotide(s) with which the recombinant microorganism is transformed confer(s) on the recombinant microorganism the ability to produce a diterpene or glycoside thereof.

The polynucleotides encoding the UGT, ent-copalyl pyrophosphate synthase, ent-Kaurene synthase, ent-Kaurene oxidase, kaurenoic acid 13-hydroxylase, UGTs, hydroxymethylglutaryl-CoA reductase, farnesyl-pyrophosphate synthetase, geranylgeranyl diphosphate synthase and/or cytochrome p450 reductase may be ligated into one or more polynucleotide constructs to facilitate transformation of the recombinant microorganism as disclosed herein.

A polynucleotide construct may be a plasmid carrying the genes encoding enzymes of the steviol glycoside pathway as disclosed herein, or a polynucleotide construct may comprise two or three plasmids carrying each three or two genes, respectively, encoding the enzymes of the steviol glycoside pathway distributed in any appropriate way.

Any suitable plasmid may be used, for instance a low copy plasmid or a high copy plasmid. It may be possible that the enzymes selected from the group consisting of UGT, ent-copalyl pyrophosphate synthase, ent-Kaurene synthase, ent-Kaurene oxidase, and kaurenoic acid 13-hydroxylase, UGTs, hydroxymethylglutaryl-CoA reductase, farnesyl-pyrophosphate synthetase, geranylgeranyl diphosphate synthase and NADPH-cytochrome p450 reductase are native to the recombinant microorganism and that transformation with one or more of the polynucleotides encoding these enzymes may not be required to confer the recombinant microorganism the ability to produce a steviol glycoside. Further improvement of steviol glycoside production by the recombinant microorganism may be obtained by classical strain improvement.

The polynucleotide construct may be maintained as an episomal entity and thus comprise a sequence for autonomous replication, such as an autosomal replication sequence. If the recombinant microorganism is of fungal origin, a suitable episomal polynucleotide construct may e.g. be based on the yeast 2μ or pKD1 plasmids (Gleer et al., 1991, Biotechnology 9: 968-975), or the AMA plasmids (Fierro et al., 1995, Curr. Genet. 29:482-489).

Alternatively, each polynucleotide construct may be integrated in one or more copies into the genome of the recombinant microorganism. Integration into the recombinant microorganism's genome may occur at random by non-homologous recombination but or the polynucleotide construct may be integrated into the recombinant microorganism's genome by homologous recombination as is well known in the art (see e.g. WO90/14423, EP-A-0481008, EP-A-0635 574 and U.S. Pat. No. 6,265,186).

Optionally, a selectable marker may be present in the polynucleotide construct.

In some embodiments, the polynucleotides encoding UGT, ent-copalyl pyrophosphate synthase, ent-Kaurene synthase, ent-Kaurene oxidase, and kaurenoic acid 13-hydroxylase, UGTs, hydroxymethylglutaryl-CoA reductase, farnesyl-pyrophosphate synthetase, geranylgeranyl diphosphate synthase and/or NADPH-cytochrome p450 reductase, are each operably linked to a promoter that causes sufficient expression of the corresponding polynucleotides in the recombinant microorganism as disclosed herein to confer to the cell the ability to produce a steviol glycoside. The promoter that could be used to achieve the expression of the polynucleotides encoding for an enzyme as defined herein above, may be not native to the polynucleotide encoding for the enzyme to be expressed, i.e. a promoter that is heterologous to the polynucleotide (coding sequence) to which it is operably linked. In some embodiments, the promoter is homologous, i.e. endogenous to the recombinant microorganism.

Suitable promoters in microorganisms as disclosed herein may be GAL7, GAL10, or GAL 1, CYC1, HIS3, ADH1, PGL, PH05, GAPDH, ADC1, TRP1, URA3, LEU2, ENO, TPI, and AOX1. Other suitable promoters include PDC, GPD1, PGK1, TEF1, and TDH.

Any terminator, which is functional in the recombinant microorganism, may be used herein. Exemplary terminators are obtained from natural genes of the recombinant microorganism. Suitable terminator sequences are well known in the art. In some embodiments, such terminators are combined with mutations that prevent nonsense mediated mRNA decay in the recombinant microorganism as disclosed herein (see for example: Shirley et al., 2002, Genetics 161:1465-1482). Polynucleotides used herein may include polynucleotide fragments that target them to desired compartments of the microorganism. For example, in an exemplary recombinant microorganism as disclosed herein, all polynucleotides, except for ent-Kaurene oxidase, kaurenoic acid 13-hydroxylase and NADPH-cytochrome p450 reductase encoding sequences may be targeted to the cytosol. This approach may be conveniently be used when the recombinant microorganism is a yeast cell.

Typically, a recombinant microorganism as disclosed herein will comprise heterologous polynucleotides. Alternatively, a recombinant microorganism as disclosed herein may comprise an entirely homologous polynucleotide, polypeptide or protein that has been modified as set out herein so that the recombinant microorganism produces increased amounts of a steviol glycoside in comparison to a non-modified version of the same microorganism.

One or more enzymes of the steviol glycoside pathway as described herein may be overexpressed to achieve a sufficient steviol glycoside production by the recombinant microorganism.

There are various means available in the art for overexpression of enzymes in the recombinant microorganism as disclosed herein. In particular, an enzyme may be overexpressed by increasing the copy number of the gene encoding for the enzyme in the recombinant microorganism, e.g. by integrating additional copies of the gene in the recombinant microorganism's genome.

An exemplary recombinant microorganism as disclosed herein may be a recombinant cell which is naturally capable of producing GGPP.

A recombinant microorganism as disclosed herein may be able to grow on any suitable carbon source known in the art and convert it to a steviol glycoside. The recombinant microorganism may be able to convert directly plant biomass, celluloses, hemicelluloses, pectines, rhamnose, galactose, fucose, maltose, maltodextrines, ribose, ribulose, or starch, starch derivatives, sucrose, lactose and glycerol. Hence, an exemplary host organism expresses enzymes such as cellulases (endocellulases and exocellulases) and hemicellulases (e.g. endo- and exo-xylanases, arabinases) necessary for the conversion of cellulose into glucose monomers and hemicellulose into xylose and arabinose monomers, pectinases able to convert pectines into glucuronic acid and galacturonic acid or amylases to convert starch into glucose monomers. In some embodiments, the recombinant microorganism is able to convert a carbon source selected from the group consisting of glucose, xylose, arabinose, sucrose, lactose and glycerol. The recombinant microorganism may for instance be a eukaryotic host cell as described in WO03/062430, WO06/009434, EP1499708B1, WO06096130 or WO04/099381.

In some embodiments, the recombinant microorganism as disclosed herein has an improved ability to produce a steviol glycoside, especially a highly glycosylated steviol glycoside, such as Rebaudioside M and/or Rebaudioside D. This improved ability can be measured by evaluating:

(a) the molar concentration of the Rebaudioside M and/or Rebaudioside D produced by the recombinant microorganism as disclosed herein, (b) the yield of the Rebaudioside M and/or Rebaudioside D produced by the recombinant microorganism as disclosed herein from a carbon source (e.g. glucose), (c) the ratio of the molar concentration of the Rebaudioside M and/or Rebaudioside D produced by the recombinant microorganism as disclosed herein over the molar concentration of the Rebaudioside A, Rebaudioside B, Rebaudioside D, Rebaudioside M, stevioside, steviolbioside and rubusoside produced by the recombinant microorganism as disclosed herein (i.e. "total steviol glycosides"), and/or (d) the ratio of the molar concentration of the Rebaudioside A, Rebaudioside B, stevioside, steviolbioside and rubusoside produced by the recombinant microorganism as disclosed herein (i.e. steviol glycosides with low level of glycosylation or "small steviol glycosides") over the molar concentration of the Rebaudioside A, Rebaudioside B, Rebaudioside D, Rebaudioside M, stevioside, steviolbioside and rubusoside produced by the recombinant microorganism as disclosed herein (i.e. "total steviol glycosides"), and comparing the above values (a), (b), (c) and/or (d) with the one(s) of the corresponding microorganism having no deficiency in a PSK, when analysed under substantially identical conditions.

In the context of the present disclosure, the wording "produced by a recombinant microorganism" when referring to a steviol glycoside means a steviol glycoside found in the fermentation broth after opening up the cells to release the cell content and optionally, after removing undissolved cellular material such as the cell walls.

In the context of the present disclosure, "analysed under substantially identical conditions" or "measured under substantially identical conditions" means that the recombinant microorganism as disclosed herein and the corresponding microorganism having no deficiency in a PSK polypeptide are cultivated under the same conditions and that the amount (concentration) of a steviol glycoside produced by said microorganisms are measured using the same conditions, preferably by using the same assay and/or methodology, more preferably within the same experiment.

In the context of the present disclosure, the wording "total steviol glycosides" (or "total SGs") refers to the total of Rebaudioside A, Rebaudioside B, Rebaudioside D, Rebaudioside M, stevioside, steviolbioside and rubusoside. In one embodiment, the molar concentration of total steviol glycosides refers to the sum of the molar concentrations of Rebaudioside A, Rebaudioside B, Rebaudioside D, Rebaudioside M, stevioside, steviolbioside and rubusoside.

In the context of the present disclosure, the wording "small steviol glycosides" (or "small SGs") refers to the total of Rebaudioside A, Rebaudioside B, stevioside, steviolbioside and rubusoside. In one embodiment, the molar concentration of "small steviol glycosides" refers to the sum of the molar concentrations of Rebaudioside A, Rebaudioside B, stevioside, steviolbioside and rubusoside.

The concentration (e.g. molar concentration) of a steviol glycoside produced by the recombinant microorganism as disclosed herein or the corresponding microorganism having no deficiency in a PSK may be measured according to the protocol described in the Examples.

In some embodiments, the molar concentration of the Rebaudioside M and/or Rebaudioside D produced by the recombinant microorganism as disclosed herein is at least 1%, 2%, 3%, 4%, 5%, 6%, 7%, 8%, 9%, 10% or at least 10%, 20%, 30%, 40%, 50%, 60%, 70%, 80%, 90%, or at least 100%, 500%, 1000% higher than the one evaluated for the corresponding microorganism having no deficiency in a PSK polypeptide, when analysed under substantially identical conditions.

In some embodiments, the yield of the Rebaudioside M and/or Rebaudioside D produced by the recombinant microorganism as disclosed herein from a carbon source (e.g. glucose) is at least 1%, 2%, 3%, 4%, 5%, 6%, 7%, 8%, 9%, 10% or at least 10%, 20%, 30%, 40%, 50%, 60%, 70%, 80%, 90%, or at least 100%, 500%, 1000% higher than the one evaluated for the corresponding microorganism having no deficiency in a PSK polypeptide, when analysed under substantially identical conditions.

In some embodiments, the ratio of the molar concentration of the Rebaudioside M and/or Rebaudioside D produced by the recombinant microorganism as disclosed herein over the molar concentration of the total steviol glycosides produced by the recombinant microorganism as disclosed herein is at least 1%, 2%, 3%, 4%, 5%, 6%, 7%, 8%, 9%, 10% or at least 10%, 20%, 30%, 40%, 50%, 60%, 70%, 80%, 90%, or at least 100%, 500%, 1000% higher than the one evaluated for the corresponding microorganism having no deficiency in a PSK polypeptide, when analysed under substantially identical conditions.

In some embodiments, the ratio of the molar concentration of the small steviol glycosides produced by the recombinant microorganism as disclosed herein over the molar concentration of the total steviol glycosides produced by the recombinant microorganism as disclosed herein is at least 1%, 2%, 3%, 4%, 5%, 6%, 7%, 8%, 9%, 10% or at least 10%, 20%, 30%, 40%, 50%, 60%, 70%, 80%, 90%, 95% or 100% lower than the one evaluated for the corresponding microorganism having no deficiency in a PSK polypeptide, when analysed under substantially identical conditions.

The recombinant microorganism as disclosed herein can conveniently be used for the production of a steviol glycoside as disclosed herein.

Provided is a process for producing a steviol glycoside which process comprises, culturing a recombinant microorganism as disclosed herein under conditions conducive to the production of the steviol glycoside, and optionally recovering the steviol glycoside.

The term culturing is herein interchangeably used with the fermentation.

In some embodiments, the culture medium used in the process for the production of a steviol glycoside may be any suitable culture medium which allows culturing of the particular recombinant microorganism disclosed herein. The essential elements of the culture medium are known to the person skilled in the art and may be adapted to the recombinant microorganism selected.

In some embodiments, the culture medium comprises a carbon source selected from the group consisting of plant biomass, celluloses, hemicelluloses, pectines, rhamnose, galactose, fucose, fructose, maltose, maltodextrines, ribose, ribulose, or starch, starch derivatives, sucrose, lactose, fatty acids, triglycerides and glycerol. In some embodiments, the culture medium also comprises a nitrogen source such as ureum, or an ammonium salt such as ammonium sulphate, ammonium chloride, ammoniumnitrate or ammonium phosphate.

In some embodiments, the culture process or fermentation process as disclosed herein may be carried out in batch, fed-batch or continuous mode. A separate hydrolysis and fermentation (SHF) process or a simultaneous saccharification and fermentation (SSF) process may also be applied. A combination of these fermentation process modes may also be possible for optimal productivity. A SSF process may be particularly attractive if starch, cellulose, hemicelluose or pectin is used as a carbon source in the fermentation process, where it may be necessary to add hydrolytic enzymes, such as cellulases, hemicellulases or pectinases to hydrolyse the substrate.

In some embodiments, the recombinant microorganism used in the process for the preparation of a steviol glycoside may be any suitable recombinant microorganism as defined herein. It may be advantageous to use a recombinant eukaryotic microorganism as disclosed herein in the process for the production of a steviol glycoside, because most eukaryotic cells do not require sterile conditions for propagation and are insensitive to bacteriophage infections. In addition, eukaryotic host cells may be grown at low pH to prevent bacterial contamination.

In some embodiments, the recombinant microorganism as disclosed herein may be a facultative anaerobic microorganism. A facultative anaerobic recombinant microorganism can be propagated aerobically to a high cell concentration. This anaerobic phase can then be carried out at high cell density which reduces the fermentation volume required substantially and may minimize the risk of contamination with aerobic microorganisms.

In some embodiments, the fermentation process for the production of a steviol glycoside as disclosed herein may be an aerobic or an anaerobic fermentation process.

An anaerobic fermentation process may be herein defined as a fermentation process run in the absence of oxygen or in which substantially no oxygen is consumed, such as less than 5, 2.5 or 1 mmol/L/h, and wherein organic molecules serve as both electron donor and electron acceptors. The fermentation process as disclosed herein may also first be run under aerobic conditions and subsequently under anaerobic conditions.

In some embodiments, the fermentation process may also be run under oxygen-limited, or micro-aerobical, conditions. Alternatively, the fermentation process may first be run under aerobic conditions and subsequently under oxygen-limited conditions. An oxygen-limited fermentation process is a process in which the oxygen consumption is limited by the oxygen transfer from the gas to the liquid. The degree of oxygen limitation is determined by the amount and composition of the ingoing gas flow as well as the actual mixing/mass transfer properties of the fermentation equipment used.

In some embodiments, the production of a steviol glycoside in the process as disclosed herein may occur during the growth phase of the recombinant microorganism, during the stationary (steady state) phase or during both phases. It may be possible to run the fermentation process at different temperatures.

In some embodiments, the process for the production of a steviol glycoside may be performed at a temperature which is optimal for the recombinant microorganism. The optimum growth temperature may differ for each recombinant microorganism and is known to the person skilled in the art. The optimum temperature might be higher than optimal for wild type organisms to grow the recombinant microorganism efficiently under non-sterile conditions under minimal infection sensitivity and lowest cooling cost. Alternatively, the process may be carried out at a temperature which is not optimal for growth of the recombinant microorganism. Indeed, we have shown that a process for the preparation of a steviol glycoside may be carried out beneficially at a sub-optimal growth temperature of a recombinant microorganism.

In some embodiments, the recovery of the steviol glycoside may be performed using any means known by the person skilled in the art.

In some embodiments, the temperature for culturing the recombinant microorganism in a process for production of a steviol glycoside may be above 20° C., 22° C., 25° C., 28° C., or above 30° C., 35° C., or above 37° C., 40° C., 42° C., and may be below 45° C. During the production phase of a steviol glycoside, however, the optimum temperature might be lower than average in order to optimize biomass stability. The temperature during this phase may be below 45° C., such as below 42° C., 40° C., 37° C., such as below 35° C., 30° C., or below 28° C., 25° C., 22° C. or below 20° C. but above 15° C.

In some embodiments, the culture is carried out at a temperature of about 29° C. or less, about 28° C. or less, about 27° C. or less, or about 26° C. or less.

In some embodiments, the pH in the fermentation medium may have a value of below 8, such as below 7.5, of below 7, such as below 7.5, of below 6, such as below 5.5, such as below 5, such as below 4.5, such as below 4, such as below pH 3.5 or below pH 3.0, or below pH 2.5 but above pH 2. An advantage of carrying out the fermentation at low pH values is that growth of contaminant bacteria in the fermentation medium may be prevented.

In some embodiments, the process as disclosed herein is carried out on an industrial scale.

In some embodiments, the product of the process as disclosed herein is one or more of steviol-13-O-glucoside, steviol-19-O-glucoside, steviol-1,2-bioside, steviol-1,3-bioside, stevioside, rebaudioside A, rebaudioside B, rebaudioside C, rebaudioside D, rebaudioside E, rebaudioside F, rebaudioside I, rebaudioside Q, rebaudioside M, rubusoside, and/or dulcoside A, preferably Rebaudioside D, Rebaudioside M, Rebaudioside Q, and/or Rebaudioside I. In some embodiments, rebaudioside A, rebaudioside D or Rebaudioside M is produced.

In the process for the production of a steviol glycoside as disclosed herein, it may be possible to achieve a concentration of above 5 mg/l fermentation broth, such as above 10 mg/l, such as above 20 mg/l, such as above 30 mg/l fermentation broth, such as above 40 mg/l, such as above 50 mg/l, such as above 60 mg/l, such as above 70, such as above 80 mg/l, such as above 100 mg/l, such as above 1 g/l, such as above 5 g/l, such as above 10 g/l, such as above 20 g/l, such as above 30 g/l, such as above 40 g/l, such as above 50 g/l, but usually below 100 g/l.

The recombinant microorganism as disclosed herein can conveniently be used for the production of a steviol glycoside by bioconversion of steviol or a steviol glycoside into another steviol glycoside.

Accordingly, there is provided for a process for producing a steviol glycoside comprising bioconversion of plant-derived steviol or synthetic steviol or plant-derived steviol glycosides or synthetic steviol glycosides comprising contacting the plant-derived or synthetic steviol or steviol glycosides with a recombinant microorganism as disclosed herein, an extract of such recombinant microorganism, a fermentation broth comprising such recombinant microorganism or a supernatant of a culture of such recombinant microorganism, and optionally recovering the steviol glycoside. There is also provided a process for producing a steviol glycoside comprising contacting steviol or steviol glycosides with a recombinant microorganism according to the invention, a fermentation broth comprising such recombinant microorganism, and optionally recovering the steviol glycoside.

In some embodiments, the (bioconversion) process is whole cell bioconversion process. In some embodiments the bioconversion is in vitro bioconversion.

In some embodiments of the process of bioconversion as disclosed herein:

steviol is converted to steviol-13-O-glucoside by a UGT1, preferably a UGT85C2, steviol-19-O-glucoside is converted to rubusoside by a UGT1, preferably a UGT85C2, steviol is converted to steviol-19-O-glucoside by a UGT3, preferably a UGT74G1, steviol-13-O-glucoside is converted to rubusoside by a UGT3, preferably a UGT74G1, steviol-1,3-bioside is converted to 1,3-stevioside (rebaudioside G) by a UGT3, preferably a UGT74G1, steviol-1,2-bioside is converted to 1,2-stevioside (also indicated as stevioside) by a UGT3, preferably a UGT74G1, rebaudioside B is converted to rebaudioside A by a UGT3, preferably a UGT74G1, steviol-13-O-glucoside is converted to steviol 1,3-bioside by a UGT4, preferably a UGT76G1, steviol-1,2-bioside is converted to rebaudioside B by a UGT4, preferably a UGT76G1, rubusoside is converted to 1,3-stevioside by a UGT4, preferably a UGT76G1, 1,3-stevioside is converted to rebaudioside Q by a UGT4, preferably a UGT76G1, 1,2-stevioside is converted to rebaudioside A by a UGT4, preferably a UGT76G1, rebaudioside A is converted to rebaudioside I by a UGT4, preferably a UGT76G1, rebaudioside E is converted to rebaudioside D by a UGT4, preferably a UGT76G1, rebaudioside D is converted to rebaudioside M by a UGT4, preferably a UGT76G1, steviol 13-O-glucoside is converted to steviol-1,2-bioside by a UGT2, preferably a UGT91 D2e, rubusoside is converted to 1,2-stevioside by a UGT2, preferably a UGT91 D2e, stevioside is converted to rebaudioside E, by a UGT2, preferably a UGT91 D2e and/or a EUGT11, and/or rebaudioside A is converted to rebaudioside D by a UGT2, preferably a EUGT11. In these embodiments, the enzymes may be those that are disclosed herein above.

In some embodiments, the process as disclosed herein is carried out on an industrial scale.

Further provided is a culture broth or a bioconversion mix comprising a steviol glycoside obtainable by the process as disclosed herein.

Further provided is a steviol glycoside obtainable or obtained by the process as disclosed herein. The steviol glycoside, such as rebaudioside A, rebaudioside D and/or rebaudioside M, produced by the processes as disclosed herein may be used in any application known for such compounds. In particular, they may for instance be used as a sweetener, such as in a food or a beverage. For example, steviol glycosides may be formulated in soft drinks, as a table-top sweetener, chewing gum, dairy product such as yoghurt (e.g. plain yoghurt), cake, cereal or cereal-based food, nutraceutical, pharmaceutical, edible gel, confectionery product, cosmetic, toothpastes or other oral cavity composition, etc. In addition, a steviol glycoside can be used as a sweetener not only for drinks, foodstuffs, and other products dedicated for human consumption, but also in animal feed and fodder with improved characteristics. Further provided is thus such foodstuff, feed or beverage which comprises said steviol glycoside, in particular rebaudioside A, rebaudioside D or rebaudioside M. During the manufacturing of foodstuffs, drinks, pharmaceuticals, cosmetics, table-top products, chewing gum the conventional methods such as mixing, kneading, dissolution, pickling, permeation, percolation, sprinkling, atomizing, infusing and other methods can be used. The steviol glycoside obtained as disclosed herein can be used in dry or liquid forms. It can be added before or after heat treatment of food products. The amount of the sweetener depends on the purpose of usage. It can be added alone or in the combination with other compounds.

Compounds produced according to the method as disclosed herein may be blended with one or more further non-calorific or calorific sweeteners. Such blending may be used to improve flavour or temporal profile or stability. A wide range of both non-calorific and calorific sweeteners may be suitable for blending with steviol glycosides. For example, non-calorific sweeteners such as mogroside, monatin, aspartame, acesulfame salts, cyclamate, sucralose, saccharin salts or erythritol. Calorific sweeteners suitable for blending with steviol glycosides include sugar alcohols and carbohydrates such as sucrose, glucose, fructose and HFCS. Sweet tasting amino acids such as glycine, alanine or serine may also be used.

The steviol glycoside can be used in the combination with a sweetener suppressor, such as a natural sweetener suppressor. It may be combined with an umami taste enhancer, such as an amino acid or a salt thereof.

The steviol glycoside can be combined with a polyol or sugar alcohol, a carbohydrate, a physiologically active substance or functional ingredient (such as a carotenoid, dietary fiber, fatty acid, saponin, antioxidant, nutraceutical, flavonoid, isothiocyanate, phenol, plant sterol or stanol (phytosterols and phytostanols), a polyols, a prebiotic, a probiotic, a phytoestrogen, soy protein, sulfides/thiols, amino acids, a protein, a vitamin, a mineral, and/or a substance classified based on a health benefits, such as cardiovascular, cholesterol-reducing or anti-inflammatory.

A composition comprising a steviol glycoside may include a flavoring agent, an aroma component, a nucleotide, an organic acid, an organic acid salt, an inorganic acid, a bitter compound, a protein or protein hydrolyzate, a surfactant, a flavonoid, an astringent compound, a vitamin, a dietary fiber, an antioxidant, a fatty acid and/or a salt.

A steviol glycoside as disclosed herein may be applied as a high intensity sweetener to produce zero calorie, reduced calorie or diabetic beverages and food products with improved taste characteristics. Also, it can be used in drinks, foodstuffs, pharmaceuticals, and other products in which sugar cannot be used.

In addition, a steviol glycoside as disclosed herein may be used as a sweetener not only for drinks, foodstuffs, and other products dedicated for human consumption, but also in animal feed and fodder with improved characteristics.

The examples of products where a steviol glycoside as disclosed herein can be used as a sweetening compound can be as alcoholic beverages such as vodka, wine, beer, liquor, sake, etc; natural juices, refreshing drinks, carbonated soft drinks, diet drinks, zero calorie drinks, reduced calorie drinks and foods, yogurt drinks, instant juices, instant coffee, powdered types of instant beverages, canned products, syrups, fermented soybean paste, soy sauce, vinegar, dressings, mayonnaise, ketchups, curry, soup, instant bouillon, powdered soy sauce, powdered vinegar, types of biscuits, rice biscuit, crackers, bread, chocolates, caramel, candy, chewing gum, jelly, pudding, preserved fruits and vegetables, fresh cream, jam, marmalade, flower paste, powdered milk, ice cream, sorbet, vegetables and fruits packed in bottles, canned and boiled beans, meat and foods boiled in sweetened sauce, agricultural vegetable food products, seafood, ham, sausage, fish ham, fish sausage, fish paste, deep fried fish products, dried seafood products, frozen food products, preserved seaweed, preserved meat, tobacco, medicinal products, and many others. In principal, it can have unlimited applications.

The sweetened composition comprises a beverage, non-limiting examples of which include non-carbonated and carbonated beverages such as colas, ginger ales, root beers, ciders, fruit-flavored soft drinks (e.g., citrus-flavored soft drinks such as lemon-lime or orange), powdered soft drinks, and the like; fruit juices originating in fruits or vegetables, fruit juices including squeezed juices or the like, fruit juices containing fruit particles, fruit beverages, fruit juice beverages, beverages containing fruit juices, beverages with fruit flavorings, vegetable juices, juices containing vegetables, and mixed juices containing fruits and vegetables; sport drinks, energy drinks, near water and the like drinks (e.g., water with natural or synthetic flavorants); tea type or favorite type beverages such as coffee, cocoa, black tea, green tea, oolong tea and the like; beverages containing milk components such as milk beverages, coffee containing milk components, cafe au lait, milk tea, fruit milk beverages, drinkable yogurt, lactic acid bacteria beverages or the like; and dairy products.

Generally, the amount of sweetener present in a sweetened composition varies widely depending on the particular type of sweetened composition and its desired sweetness. Those of ordinary skill in the art can readily discern the appropriate amount of sweetener to put in the sweetened composition can be used in dry or liquid forms. It can be added before or after heat treatment of food products. The amount of the sweetener depends on the purpose of usage. It can be added alone or in the combination with other compounds.

During the manufacturing of foodstuffs, drinks, pharmaceuticals, cosmetics, table-top products, chewing gum the conventional methods such as mixing, kneading, dissolution, pickling, permeation, percolation, sprinkling, atomizing, infusing and other methods can be used.

Thus, compositions as disclosed herein can be made by any method known to those skilled in the art that provide homogenous even or homogeneous mixtures of the ingredients. These methods include dry blending, spray drying, agglomeration, wet granulation, compaction, co-crystallization and the like.

In solid form, a steviol glycoside produced as disclosed herein can be provided to consumers in any form suitable for delivery into the comestible to be sweetened, including sachets, packets, bulk bags or boxes, cubes, tablets, mists, or dissolvable strips. The composition can be delivered as a unit dose or in bulk form.

For liquid sweetener systems and compositions convenient ranges of fluid, semi-fluid, paste and cream forms, appropriate packing using appropriate packing material in any shape or form shall be invented which is convenient to carry or dispense or store or transport any combination containing any of the above sweetener products or combination of product produced above.

The composition may include various bulking agents, functional ingredients, colorants, flavors.

A reference herein to a patent document or other matter which is given as prior art is not to be taken as an admission that that document or matter was known or that the information it contains was part of the common general knowledge as at the priority date of any of the claims.

The disclosure of each reference set forth herein is incorporated herein by reference in its entirety.

The following list of embodiments of the disclosure is hereafter presented which however does not intend to be limiting.

1. A recombinant microorganism comprising, preferably expressing, one or more polynucleotide(s) encoding one or more polypeptide(s) having uridine diphosphate-dependent glycosyltransferase (UGT) activity, wherein said recombinant microorganism has a deficiency in PSK1.
2. A recombinant microorganism according to embodiment 1, wherein said PSK1 comprises or consists of a polypeptide having at least about 30% sequence identity with SEQ ID NO: 26.
3. A recombinant microorganism according to any one of the preceding embodiments, wherein the deficiency in PSK1 is a reduction of at least about 40% in PSK1 activity.
4. A recombinant microorganism according to any one of the preceding embodiments, wherein the recombinant microorganism comprises, preferably expresses:
   (a) a polynucleotide encoding a functional UGT1 polypeptide,
   (b) a polynucleotide encoding a functional UGT3 polypeptide,
   (c) a polynucleotide encoding a functional UGT4 polypeptide,
   (d) a polynucleotide encoding a first functional UGT2 polypeptide, and/or
   (e) a polynucleotide encoding a second functional UGT2 polypeptide.
5. A recombinant microorganism according to any one of the preceding embodiments, wherein the recombinant microorganism comprises, preferably expresses:
   (a) a polynucleotide encoding a UGT1 polypeptide capable of glycosylating steviol or a precursor steviol glycoside at a C-13 hydroxyl group present in said steviol or precursor steviol glycoside, preferably wherein the glycosylation is a beta-glycosylation, such as a UGT85C2 polypeptide,
   (b) a polynucleotide encoding a UGT3 polypeptide capable of glycosylating steviol or a precursor steviol glycoside at a C-19 carboxyl group present in said steviol or precursor steviol glycoside, preferably wherein the glycosylation is a beta-glycosylation, such as a UGT74G1 polypeptide,
   (c) a polynucleotide encoding a UGT4 polypeptide capable of beta 1,3 glycosylation of the C3' of a 13-O-glucose, of a 19-O-glucose or both the 13-O-glucose and the 19-O-glucose of a precursor steviol glycoside having a 13-O-glucose, a 19-O-glucose, or both a 13-O-glucose and a 19-O-glucose, such as a UGT76G1 polypeptide,
   (d) a polynucleotide encoding a first UGT2 polypeptide capable of beta 1,2 glycosylation of the C2' of the 13-O-glucose, of the 19-O-glucose or both the 13-O-glucose and the 19-O-glucose of a precursor steviol glycoside having a 13-O-glucose, a 19-O-glucose, or both the 13-O-glucose and the 19-O-glucose, preferably a UGT2 polypeptide having at least uridine 5'-diphospho glucosyl: steviol-13-O-glucoside transferase activity, such as a UGT91d2 polypeptide, and/or
   (e) a polynucleotide encoding a second UGT2 polypeptide capable of beta 1,2 glycosylation of the C2' of the 13-O-glucose, of the 19-O-glucose or both the 13-O-glucose and the 19-O-glucose of the precursor steviol glycoside having a 13-O-glucose, a 19-O-glucose, or both the 13-O-glucose and the 19-O-glucose, wherein the second UGT2 polypeptide has an higher beta 1,2 glycosylation activity at the C2' of the 19-O-glucose in the precursor steviol glycoside if compared with the same activity in the first UGT2 polypeptide, such as a EUGT11 polypeptide; and wherein the microorganism produces a steviol glycoside, such as: steviol-13-O-glucoside, steviol-19-O-glucoside, steviol-1,2-bioside, steviol-1,3-bioside, stevioside, rebaudioside A, rebaudioside B, rebaudioside C, rebaudioside D, rebaudioside E, rebaudioside F, rebaudioside I, rebaudioside Q, rebaudioside M, rubusoside, and/or dulcoside A, preferably at least Rebaudioside D and/or Rebaudioside M.
6. A recombinant microorganism according to any one of the preceding embodiments, wherein the recombinant microorganism additionally comprises, preferably expresses:
   (f) a polynucleotide encoding a geranyl-geranyl pyrophosphate synthase (GGPPS),
   (g) a polynucleotide encoding an ent-copalyl diphosphate synthase (CDPS),
   (h) a polynucleotide encoding a kaurene oxidase (KO),
   (i) a polynucleotide encoding a kaurene synthase (KS), and/or
   (j) a polynucleotide encoding a kaurenoic acid 13-hydroxylase (KAH); and wherein the microorganism produces a steviol glycoside, such as: steviol-13-O-glucoside, steviol-19-O-glucoside, steviol-1,2-bioside, steviol-1,3-bioside, stevioside, rebaudioside A, rebaudioside B, rebaudioside C, rebaudioside D, rebaudioside E, rebaudioside F, rebaudioside I, rebaudioside Q, rebaudioside M, rubusoside, and/or dulcoside A, preferably at least Rebaudioside D, and/or Rebaudioside M.
7. A recombinant microorganism according to any one of the preceding embodiments, wherein the recombinant microorganism additionally comprises, preferably expresses, a polynucleotide encoding a cytochrome P450 reductase (CPR).
8. A recombinant microorganism according to any one of the preceding embodiments, wherein the ability of the recombinant microorganism to produce geranylgeranyl diphosphate (GGPP) is upregulated.
9. A recombinant microorganism according to embodiment 8, comprising one or more polynucleotide(s) encoding hydroxymethylglutaryl-CoA reductase, farnesyl-pyrophosphate synthetase and geranylgeranyl diphosphate synthase, whereby expression of the polynucleotide(s) confer(s) on the recombinant microorganism the ability to produce elevated levels of GGPP.
10. A recombinant microorganism according to any one of the preceding embodiments, wherein the recombinant microorganism belongs to one of the genera *Saccharomyces, Aspergillus, Pichia, Kluyveromyces, Candida,*

*Hansenula, Humicola, Trichosporon, Brettanomyces, Pachysolen, Yarrowia, Yamadazyma* or *Escherichia*.

11. A recombinant microorganism according to embodiment 10, wherein the recombinant microorganism is a *Saccharomyces cerevisiae* cell, a *Yarrowia lipolytica* cell or an *Escherichia coli* cell.
12. A process for producing a steviol glycoside which process comprises culturing a recombinant microorganism according to any one of embodiments 4 to 11 under conditions conducive to the production of the steviol glycoside, and optionally recovering the steviol glycoside.
13. A process for producing a steviol glycoside comprising contacting steviol or steviol glycosides with a recombinant microorganism according to any one of embodiments 1 to 11, a fermentation broth comprising such recombinant microorganism, and optionally recovering the steviol glycoside.
14. A process according to embodiment 13, wherein the process is a whole cell bioconversion process.
15. A process according to embodiment 14, wherein
    steviol is converted to steviol-13-O-glucoside by a UGT1, preferably a UGT85C2,
    steviol-19-O-glucoside is converted to rubusoside by a UGT1, preferably a UGT85C2,
    steviol-13-O-glucoside is converted to rubusoside by a UGT3, preferably a UGT74G1,
    steviol-1,2-bioside is converted to 1,2-stevioside by a UGT3, preferably a UGT74G1,
    rebaudioside B is converted to rebaudioside A by a UGT3, preferably a UGT74G1,
    steviol-1,2-bioside is converted to rebaudioside B by a UGT4, preferably a UGT76G1,
    1,2-stevioside is converted to rebaudioside A by a UGT4, preferably a UGT76G1,
    rebaudioside E is converted to rebaudioside D by a UGT4, preferably a UGT76G1,
    rebaudioside D is converted to rebaudioside M by a UGT4, preferably a UGT76G1,
    steviol 13-O-glucoside is converted to steviol-1,2-bioside by a UGT2, preferably a UGT91 D2e,
    rubusoside is converted to 1,2-stevioside by a UGT2, preferably a UGT91 D2e,
    stevioside is converted to rebaudioside E, by a UGT2, preferably a UGT91 D2e and/or a EUGT11, and/or
    rebaudioside A is converted to rebaudioside D by a UGT2, preferably a EUGT11.
16. A culture broth or a bioconversion mix comprising a steviol glycoside obtainable by the process according to any one of embodiments 12 to 15.
17. A steviol glycoside obtainable by the process according to any one of embodiments 12 to 15 or isolated from the broth or mix from embodiment 16.
18. A foodstuff, feed or beverage which comprises a steviol glycoside according to embodiment 17.

The disclosure is further illustrated by the following Examples:

EXAMPLES

Genetic Modification Techniques

Standard genetic techniques, such as overexpression of enzymes in a recombinant microorganism as well as for additional genetic modification of recombinant microorganism, are known methods in the art, such as described in Sambrook and Russel (2001) "Molecular Cloning: A Laboratory Manual (3rd edition), Cold Spring Harbor Laboratory, *Cold Spring Harbor Laboratory Press*, or F. Ausubel et al, eds., "Current protocols in molecular biology", Green Publishing and Wiley Interscience, New York (1987). Methods for transformation and genetic modification of fungal host cells are known from e.g. EP-A-0 635 574, WO 98/46772, WO 99/60102 and WO 00/37671.

A description of the sequences is set out in Table 1. Sequences described herein may be defined with reference to the sequence listing or with reference to the database accession numbers also set out in Table 1.

Assay for Measuring Steviol Glycosides (SGs)

Steviol glycosides in the fermentation samples were analysed on an Ultimate 3000 HPLC (Thermo) coupled to a PDA detector (UV absorbance at 210 nm). The steviol glycosides included Rebaudioside A, Rebaudioside B, Rebaudioside D, Rebaudioside M, stevioside, steviolbioside and rubusoside.

The chromatographic separation was achieved with a 4.6×150 mm 3 μm particle size, Waters Atlantis C-18 column, using a gradient elution with (A) 25% acetonitrile and B) 100% acetonitrile as mobile phases. The 22 min. gradient started from 0% B linearly increasing to 46% B in 13 minutes, further linearly increased to 98% B in 0.1 minute and kept there for 4 minutes, followed by 100% A from 17.1 minutes up to 22 minutes. The flow rate was kept at 1 ml/min, using an injection volume of 10 μl and the column temperature was set to 50° C. The desired components were quantified using an external one-point calibration of the Rebaudioside A and M standards at the concentrations of about 200 μg/mL. The linear range of the method is 0-200 μg/mL. The concentrations of Rebaudioside B and D were calculated based on the Rebaudioside A external standard using relative response factors reported in FCC 9 monograph for Rebaudioside A.

Commercially available references were used for Rebaudioside A, Rebaudioside B, Rebaudioside D, stevioside, steviolbioside and rubusoside. References for Rebaudioside M were provided by DSM.

Example 1. Production of Steviol Glycosides in Strains STV2019 and PSK1-Deficient STV2019

*Yarrowia lipolytica* strain STV2019 in Example 7 of patent application WO2015/007748 comprises all elements required for the production of steviol steviol glycosides such as rebaudioside A (RebA), rebaudioside D (RebD) and rebaudioside M (RebM). Construction of strain STV2019 is extensively described in WO2015/007748; STV2019 expresses the enzymes listed in Table 2 here below. WO2015/007748 is herein incorporated by reference.

Strain STV2019 is made deficient in PSK1 (SEQ ID NO: 25 (open reading frame); SEQ ID NO: 26 (protein)) by replacing the PSK1 open reading frame by a dominant marker (hygromycin) by homologous recombination.

The effect of the PSK1 deficiency compared to the wild type cell, is an increase in yield of rebaudioside M (g/kg glucose) of about 10% and an increase in percentage rebaudioside M of 15% in view of other steviol glycosides.

The results clearly indicate the benefit of PSK1 deficiency for the production of at least rebaudioside M.

TABLE 2

| Polypeptide sequences of the enzymes involved in the biosynthetic pathway of steviol glycosides | | |
|---|---|---|
| Sequence | Annotation | Description |
| SEQ ID NO: 27 | tHMG | Truncated 3-hydroxy-3-methylglutaryl coenzyme A reductase |
| SEQ ID NO: 28 | GGS | Variant Geranylgeranyl diphosphate synthase |
| SEQ ID NO: 29 | CPS | Copalyl diphosphate synthase |
| SEQ ID NO: 30 | KS | Kaurene synthase |
| SEQ ID NO: 31 | KO2 | Kaurene oxidase |
| SEQ ID NO: 32 | KO_Gib | Kaurene oxidase |
| SEQ ID NO: 33 | KAH | Kaurenoic acid 13-hydroxylase |
| SEQ ID NO: 34 | KAH4_m4 | Kaurenoic acid 13-hydroxylase |
| SEQ ID NO: 35 | CPR | NADPH-cytochrome P450 reductase |
| SEQ ID NO: 36 | UGT85C2 | UDP-glucosyltransferase |
| SEQ ID NO: 37 | UGT2 | UDP-glucosyltransferase |
| SEQ ID NO: 38 | UGT74G1 | UDP-glucosyltransferase |
| SEQ ID NO: 39 | UGT76G1 | UDP-glucosyltransferase |
| SEQ ID NO: 40 | RT18 | UDP-glucosyltransferase |

Example 2. Construction of Strains STVP003, STVP004 and STVP005

*Yarrowia lipolytica* strain STVP003 was constructed in a comparable way to the *Yarrowia lipolytica* strain STVP001 described in Example 1 of patent application WO2019/211230. *Yarrowia lipolytica* strain STVP003 comprises all elements required for the production of steviol glycosides such as rebaudioside A (RebA), rebaudioside D (RebD) and rebaudioside M (RebM). It has one or several copies over-expressed of the genes listed in Table 3.

TABLE 3

| Polypeptide sequences of the enzymes involved in the biosynthetic pathway of steviol glycosides | | |
|---|---|---|
| Sequence | Annotation | Description |
| SEQ ID NO: 4 in WO2019/211230 | tHMG | Truncated 3-hydroxy-3-methylglutaryl coenzyme A reductase |
| SEQ ID NO: 5 in WO2019/211230 | GGS | Variant Geranylgeranyl diphosphate synthase |
| SEQ ID NO: 62 in WO2013/110673 | CPS | Copalyl diphosphate synthase |
| SEQ ID NO: 66 in WO2013/110673 | KS | Kaurene synthase |
| SEQ ID NO: 24 in WO2013/110673 | KO2 | Kaurene oxidase |
| SEQ ID NO: 86 in WO2015/007748 | KO_Gib | Kaurene oxidase |
| SEQ ID NO: 34 in WO2015/007748 | KAH | Kaurenoic acid 13-hydroxylase |
| SEQ ID NO: 3 in WO2017/060318 | KAH4_m4 | Kaurenoic acid 13-hydroxylase |
| SEQ ID NO: 58 in WO2013/110673 | CPR | NADPH-cytochrome P450 reductase |
| SEQ ID NO: 72 in WO2013/110673 | UGT85C2 | UDP-glucosyltransferase |
| SEQ ID NO: 25 in WO2016/146711 | UGT2 | UDP-glucosyltransferase |
| SEQ ID NO: 74 in WO2013/110673 | UGT74G1 | UDP-glucosyltransferase |
| SEQ ID NO: 76 in WO2013/110673 | UGT76G1 | UDP-glucosyltransferase |
| SEQ ID NO: 4 in WO2016/151046 | RT18 | UDP-glucosyltransferase |

The genes of Table 3 are expressed using promoters and terminators listed in Table 4.

TABLE 4

| Polynucleotide sequences of promoters and terminators | | |
|---|---|---|
| Sequences | Element type | Annotation |
| SEQ ID NO: 66 in WO2016/146711 | Promoter | pCWP |
| SEQ ID NO: 65 in WO2016/146711 | Promoter | pENO |
| SEQ ID NO: 63 in WO2016/146711 | Promoter | pHSP |
| SEQ ID NO: 64 in WO2016/146711 | Promoter | pHYPO |
| SEQ ID NO: 193 in WO2013/110673 | Promoter | pTPI |

TABLE 4-continued

| Polynucleotide sequences of promoters and terminators | | |
|---|---|---|
| Sequences | Element type | Annotation |
| SEQ ID NO: 68 in WO2016/146711 | Promoter | pYP001 |
| SEQ ID NO: 74 in WO2016/146711 | Terminator | act1T |
| SEQ ID NO: 71 in WO2016/146711 | Terminator | gpdT |
| SEQ ID NO: 57 (this disclosure) | Terminator | pdc1T |
| SEQ ID NO: 73 in WO2016/146711 | Terminator | pgkT |
| SEQ ID NO: 72 in WO2016/146711 | Terminator | pgmT |
| SEQ ID NO: 69 in WO2016/146711 | Terminator | xprT |

Figure 2:
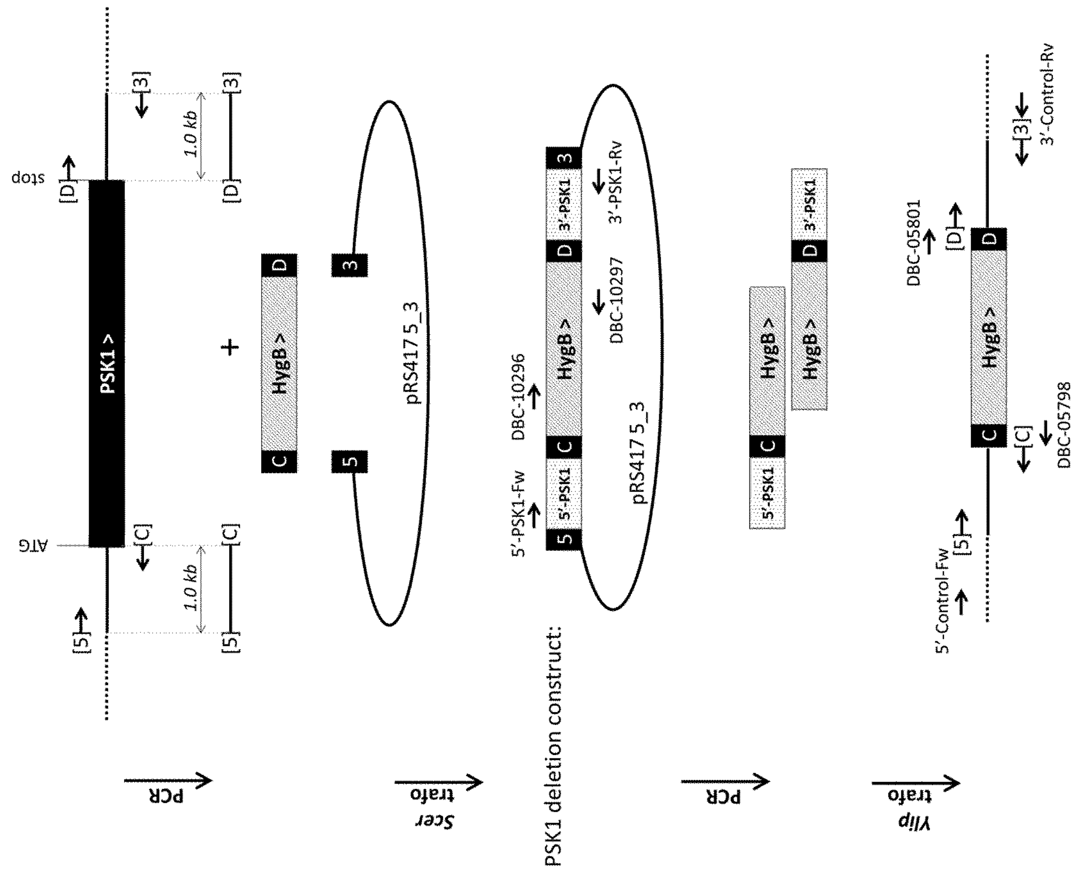
FIG. 2 sets out a schematic diagram of the construction of the PSK1 deletion construct and the final genomic modification after correct integration of the split marker fragment. Scer trafo: transformation into *Saccharomyces cerevisiae*. Ylip trafo: transformation into *Yarrowia lipolytica.*

The PSK1 open reading frame (as defined in SEQ ID NO: 25) encoding for the *Yarrowia lipolytica* endogenous serine/threonine protein kinase 1, i.e. PSK1 (SEQ ID NO: 26), was replaced by a dominant marker (hygromycin) in strain STVP003 by homologous recombination according to the strategy depicted in FIG. 2.

For this, a PSK1 deletion construct was first assembled in *Saccharomyces cerevisiae*. A 1-kb fragment located directly upstream of PSK1 (5'-PSK1; SEQ ID NO: 3) was amplified from *Yarrowia lipolytica* genomic DNA using appropriate primers ([5]-5'-PSK1-Fw and [C]-5'-PSK1-Rv; SEQ ID NOs: 11 and 12). These primers introduced additional 50 bp sequences "5" and "C" (SEQ ID NOs: 2 and 4), allowing plasmid assembly by homologous recombination in *S. cerevisiae*. In the same way, a 1-kb fragment located directly downstream of PSK1 (3'-PSK1; SEQ ID NO: 9) was generated from *Yarrowia lipolytica* genomic DNA using primers [D]-3'-PSK1-Fw and [3]-3'-PSK1-Rv (SEQ ID NOs: 15 and 16) adding on either site the 50 bp sequences "D" and "3" (SEQ ID NOs: 8 and 10). A third fragment was an expression cassette for HygB (encoding for resistance against hygromycin), which was amplified with primers DBC-05799 and DBC-05800 (SEQ ID NOs: 13 and 14). These three fragments together with a linearized pRS417 5_3 destination vector (SEQ ID NO: 1) were transformed into *S. cerevisiae*. Upon assembly in *S. cerevisiae* with recombination over the sequences "5", "C", "D" and "3" (SEQ ID NOs: 2, 4, 8 and 10), the PSK1 deletion construct consisted of a 5'-PSK1 flank, the HygB expression cassette and a 3'-PSK1 flank.

The plasmid containing the PSK1 deletion construct was isolated from *S. cerevisiae* (according to method described in WO2015/007748) and the PSK1 deletion construct was used to PCR-amplify two fragments. To generate the 5'-fragment consisting of the 5'-PSK1 and 5'-HygB, primers 5'-PSK1-Fw and DBC-10297 (SEQ ID NOs: 17 and 18) were used in the PCR. The other fragment, consisting of 3'-HygB and 3'-PSK1, was generated with primers DBC-10296 and 3'-PSK1-Rv (SEQ ID NOs: 19 and 20). Both fragments shared 0.96 kb identity in the HygB open reading frame.

The purified PCR products were transformed into *Y. lipolytica* strain STVP003 and transformants were selected on YEPhD plates containing 100 μg/ml hygromycin. Correct integration of the HygB cassette at the PSK1 locus after homologous recombination over the 5'- and 3'-PSK1 flanks was confirmed in a colony PCR with primers 5'-Control-Fw and DBC-05798 (SEQ ID NOs: 21 and 22) for the 5'-integration site and with primers DBC-05801 and 3'-Control-Rv (SEQ ID NOs: 23 and 24) for the 3'-integration site.

Two deletion strains with the correct replacement of the PSK1 open reading frame were selected and named strains STVP004 and STVP005.

Example 3. Production of Steviol Glycosides in Strains STVP003, STVP004 and STVP005

To establish the effect of the deficiency in PSK1, strains STVP003, STVP004 and STVP005 were cultivated in shake-flasks (0.5 L with 60 ml medium) for 2 days at 30° C. and 280 rpm. The medium was based on Verduyn et al. (Verduyn C, Postma E, Scheffers W A, Van Dijken J P. Yeast, 1992 July; 8(7):501-517) with modifications in the carbon and nitrogen sources as described in Tables 5.

TABLE 5

Preculture medium composition

| | Formula | Concentration (g/kg) |
|---|---|---|
| **Raw material** | | |
| Glucose | $C_6H_{12}O_6$ | 60 |
| Urea | $(NH_2)_2CO$ | 6.9 |
| Potassium dihydrogen phosphate | $KH_2PO_4$ | 9 |
| Magnesium sulphate | $MgSO_4 \cdot 7H_2O$ | 1.5 |
| Trace elements solution[a] | | 3 |
| Vitamins solution[b] | | 3 |
| **Component** | | |
| EDTA | $C_{10}H_{14}N_2Na_2O_8 \cdot 2H_2O$ | 15.00 |
| Zinc sulphate.$7H_2O$ | $ZnSO_4 \cdot 7H_2O$ | 4.50 |
| Manganese chloride. $2H_2O$ | $MnCl_2 \cdot 2H_2O$ | 0.84 |
| Cupper (II) sulphate. $5H_2O$ | $CuSO_4 \cdot 5H_2O$ | 0.30 |
| Sodium molybdenum. $2H_2O$ | $Na_2MoO_4 \cdot 2H_2O$ | 0.40 |
| Calcium chloride. $2H_2O$ | $CaCl_2 \cdot 2H_2O$ | 4.50 |
| Iron sulphate. $7H_2O$ | $FeSO_4 \cdot 7H_2O$ | 3.00 |
| Potassium iodide | KI | 0.10 |
| Biotin (D-) | $C_{10}H_{16}N_2O_3S$ | 0.05 |
| Ca D(+) panthothenate | $C_{18}H_{32}CaN_2O_{10}$ | 1.00 |
| Nicotinic acid | $C_6H_5NO_2$ | 1.00 |
| Myo-inositol | $C_6H_{12}O_6$ | 25.00 |
| Thiamine chloride hydrochloride | $C_{12}H_{18}Cl_2N_4OS.xH_2O$ | 1.00 |
| Pyridoxal hydrochloride | $C_8H_{12}ClNO_3$ | 1.00 |
| p-aminobenzoic acid | $C_7H_7NO_2$ | 0.20 |

[a]Trace elements solution
[b]Vitamin solution

Subsequently, 40 ml of the pre-cultures were transferred into fermenters (starting volume 0.4 L) containing the medium as set out in Tables 6. During cultivation, the pH was controlled at 5.7 by addition of ammonia (10 w/w %), the temperature was controlled at 30° C., and the pO2 was controlled at 20% (relative to air saturation) by adjusting the stirrer speed. The glucose concentration was kept limited by controlled 55 wt % glucose feed to the fermenter. After 143 hours of cultivation, the broths were collected for sample preparation and quantification of the steviol glycosides.

TABLE 6

Fermentation medium composition

| | Formula | Concentration (g/kg) |
|---|---|---|
| **Raw material** | | |
| Glucose | $C_6H_{12}O_6$ | 60 |
| Ammonium sulphate | $(NH_4)_2SO_4$ | 1 |
| Potassium dihydrogen phosphate | $KH_2PO_4$ | 20 |
| Magnesium sulphate | $MgSO_4.7H_2O$ | 10 |
| Trace elements solution[a] | | 16 |
| Vitamins solution[b] | | 16 |
| **Component** | | |
| EDTA | $C_{10}H_{14}N_2Na_2O_8 \cdot 2H_2O$ | 15.00 |
| Zinc sulphate.$7H_2O$ | $ZnSO_4 \cdot 7H_2O$ | 4.50 |
| Manganese chloride. $2H_2O$ | $MnCl_2 \cdot 2H_2O$ | 0.84 |
| Cupper (II) sulphate. $5H_2O$ | $CuSO_4 \cdot 5H_2O$ | 0.30 |
| Sodium molybdenum. $2H_2O$ | $Na_2MoO_4 \cdot 2H_2O$ | 0.40 |
| Calcium chloride. $2H_2O$ | $CaCl_2 \cdot 2H_2O$ | 4.50 |
| Iron sulphate. $7H_2O$ | $FeSO_4 \cdot 7H_2O$ | 3.00 |
| Potassium iodide | KI | 0.10 |
| Biotin (D-) | $C_{10}H_{16}N_2O_3S$ | 0.05 |
| Ca D(+) panthothenate | $C_{18}H_{32}CaN_2O_{10}$ | 1.00 |
| Nicotinic acid | $C_6H_5NO_2$ | 1.00 |
| Myo-inositol | $C_6H_{12}O_6$ | 25.00 |
| Thiamine chloride hydrochloride | $C_{12}H_{18}Cl_2N_4OS.xH_2O$ | 1.00 |
| Pyridoxal hydrochloride | $C_8H_{12}ClNO_3$ | 1.00 |
| p-aminobenzoic acid | $C_7H_7NO_2$ | 0.20 |

[a]Trace elements solution
[b]Vitamin solution

The fermentation samples for the quantification of the steviol glycosides were prepared by first diluting the homogenized whole broths with water followed by 1.3 times dilution with acetonitrile (with final acetonitrile concentration of 25%) so that the final concentrations of the steviol glucosides are in the linear measuring range of 0-200 μg/mL. The samples were then centrifuged for 10 minutes at 3700 rpm and the supernatants were used for quantification of the steviol glycosides with the assay as described herein above.

The molar concentration of the produced Rebaudioside M (referred as "RebM"), the yield of the produced Rebaudioside M from glucose (referred as "Yps RebM"), the ratio of the molar concentration of the produced Rebaudioside M over the molar concentration of the produced Rebaudioside A, Rebaudioside B, Rebaudioside D, Rebaudioside M, stevioside, steviolbioside and rubusoside (referred as "RebM/Total SGs"), and the ratio of the molar concentration of the produced Rebaudioside A, Rebaudioside B, stevioside, steviolbioside and rubusoside (i.e. steviol glycosides with low level of glycosylation) over the molar concentration of the produced Rebaudioside A, Rebaudioside B, Rebaudioside D, Rebaudioside M, stevioside, steviolbioside and rubusoside (referred as "small SGs/Total SGs") are presented in Table 7 for strain STVP003 and the PSK1 deletion strains STVP004 and STVP005. The values were normalized to the corresponding values in strain STVP003 which has no deficiency in PSK1.

TABLE 7

Molar concentration of produced Rebaudioside M ("RebM"), yield of produced Rebaudioside M from glucose ("Yps RebM"), ratio of molar concentration of produced Rebaudioside M over molar concentration of produced Rebaudioside A, Rebaudioside B, Rebaudioside D, Rebaudioside M, stevioside, steviolbioside and rubusoside ("RebM/Total SGs"), and ratio of molar concentration of produced Rebaudioside A, Rebaudioside B, stevioside, steviolbioside and rubusoside over molar concentration of produced Rebaudioside A, Rebaudioside B, Rebaudioside D, Rebaudioside M, stevioside, steviolbioside and rubusoside ("Small SGs/Total SGs") in STVP003, STVP004 and STVP005. The values were normalized to the corresponding values in strain STVP003 which has no deficiency in PSK1.

| Strain | Normalized RebM | Normalized Yps RebM | Normalized RebM/ Total SGs | Normalized Small SGs/ Total SGs |
|---|---|---|---|---|
| STVP003 | 100 | 100 | 100 | 100 |
| STVP004 | 139.5 | 135.3 | 142.7 | 51.9 |
| STVP005 | 140.3 | 140.2 | 142.4 | 52.2 |

Comparison of the production data for the parent strain STVP003 and the PSK1 deletion strains STVP004 and STVP005 shows that the deficiency in a PSK in yeast, in this case PSK1, had a positive impact in the production of steviol glycosides, especially in the production of the highly glycosylated steviols glycosides such as RebM. Indeed, as illustrated in Table 7, the molar concentrations of produced Rebaudioside M ("RebM"), yields of produced Rebaudioside M from glucose ("Yps RebM"), and the ratio of molar concentration of produced Rebaudioside M over molar concentration of produced Rebaudioside A, Rebaudioside B, Rebaudioside D, Rebaudioside M, stevioside, steviolbioside and rubusoside ("RebM/Total SGs") were much higher in the PSK1 deletion strains STVP004 and STVP005 as compared to the ones in the parent strains STVP003. In said PSK1 deletion strains, the molar concentrations "RebM", the yields "Yps RebM" and the ratios "RebM/Total SGs" were about 40%, 35 to 40%, and about 40% higher than in the parent strain STVP003, respectively.

Also, the data in Table 7 show that the ratios of molar concentration of undesired steviol glycosides (e.g. Rebaudioside A, Rebaudioside B, stevioside, steviolbioside and rubusoside) over molar concentration of the total steviol glycosides were much lower in the PSK1 deletion strains STVP004 and STVP005 as compared to the parent strain STVP003. In said PSK1 deletion strains, the ratios "Small SGs/Total SGs" were about 50% lower than in the parent strain STVP003. In said PSK1 deletion strains, the highly glycosylated steviol glycosides, such as Rebaudioside M and Rebaudioside D, are therefore produced in higher levels of purity when compared with the parent strain STVP003.

Altogether, these results illustrate that a recombinant microorganism capable of producing a desired steviol glycoside, such as Rebaudioside M and Rebaudioside D, clearly benefits from having a deficiency in a serine/threonine protein kinase such as PSK1.

Example 4. Construction of Strains STVP006, STVP007, STVP008, STVP009, STVP010 and STVP011

*Yarrowia lipolytica* strain STVP006 is constructed in a comparable way to the *Yarrowia lipolytica* strain STVP002 as described in the Examples of patent application WO2019/211230. *Yarrowia lipolytica* strain STVP006 comprises all elements required for the production of steviol glycosides such as rebaudioside A, rebaudioside D and rebaudioside M. It has one or several copies over-expressed of the genes listed in Table 8.

TABLE 8

Polypeptide sequences of the enzymes involved in the biosynthetic pathway of steviol glycosides

| Sequence | Annotation | Description |
|---|---|---|
| SEQ ID NO: 4 in WO2019/211230 | tHMG | Truncated 3-hydroxy-3-methylglutaryl coenzyme A reductase |
| SEQ ID NO: 5 in WO2019/211230 | GGS | Variant Geranylgeranyl diphosphate synthase |
| SEQ ID NO: 62 in WO2013/110673 | CPS | Copalyl diphosphate synthase |
| SEQ ID NO: 66 in WO2013/110673 | KS | Kaurene synthase |
| SEQ ID NO: 24 in WO2013/110673 | KO2 | Kaurene oxidase |
| SEQ ID NO: 86 in WO2015/007748 | KO_Gib | Kaurene oxidase |
| SEQ ID NO: 34 in WO2015/007748 | KAH | Kaurenoic acid 13-hydroxylase |
| SEQ ID NO: 3 in WO2017/060318 | KAH4_m4 | Kaurenoic acid 13-hydroxylase |
| SEQ ID NO: 6 in WO2019/211230 | KAH60 | Kaurenoic acid 13-hydroxylase |
| SEQ ID NO: 58 in WO2013/110673 | CPR | NADPH-cytochrome P450 reductase |
| SEQ ID NO: 72 in WO2013/110673 | UGT85C2 | UDP-glucosyltransferase |
| SEQ ID NO: 25 in WO2016/146711 | UGT2 | UDP-glucosyltransferase |
| SEQ ID NO: 74 in WO2013/110673 | UGT74G1 | UDP-glucosyltransferase |
| SEQ ID NO: 76 in WO2013/110673 | UGT76G1 | UDP-glucosyltransferase |
| SEQ ID NO: 4 in WO2016/151046 | RT18 | UDP-glucosyltransferase |

The genes of Table 8 are expressed using promoters and terminators listed in Table 9.

TABLE 9

Polynucleotide sequences of promoters and terminators

| Sequences | Element type | Annotation |
|---|---|---|
| SEQ ID NO: 66 in WO2016146711 | Promoter | pCWP |
| SEQ ID NO: 65 in WO2016146711 | Promoter | pENO |
| SEQ ID NO: 63 in WO2016146711 | Promoter | pHSP |
| SEQ ID NO: 64 in WO2016146711 | Promoter | pHYPO |
| SEQ ID NO: 193 in WO2013110673 | Promoter | Yl_TPI.pro |
| SEQ ID NO: 68 in WO2016146711 | Promoter | Yl_YP001.pro |
| SEQ ID NO: 21 in WO2016151046 | Promoter | Yl_SCP2.pro |
| SEQ ID NO: 74 in WO2016146711 | Terminator | Yl_ACT1.ter |
| SEQ ID NO: 71 in WO2016146711 | Terminator | gpdT |
| SEQ ID NO: 73 in WO2016146711 | Terminator | pgkT |
| SEQ ID NO: 72 in WO2016146711 | Terminator | pgmT |
| SEQ ID NO: 69 in WO2016146711 | Terminator | xprT |

Strain STVP007 is constructed by introducing a mutation in the PSK1 open reading frame (as defined in SEQ ID NO: 25) of STVP006, resulting in the generation of a stop codon.

The presence of the point mutation is confirmed by sequence analysis. Said mutation affects the lysine residue at position 317 in SEQ ID NO: 26, leading to a truncated PSK1 polypeptide with a deficient activity.

STVP008 is constructed by deleting the PSK1 open reading frame (as defined in SEQ ID NO: 25) encoding for the endogenous PSK1 in STVP006. Deletion of the complete gene is confirmed by PCR using primers located upstream and downstream of the PSK1 open reading frame.

STVP009, STVP010 and STVP011 are constructed by generating deletions of various sizes at the 5'-end of the PSK1 promoter in STVP006. In STVP009, the PSK1 promoter is deleted to leave 200 bp of the original PSK1 promoter directly in front of ATG of the PSK1 open reading frame. In STVP010, the PSK1 promoter is deleted to leave 100 bp of the original PSK1 promoter directly in front of ATG of the PSK1 open reading frame. In STVP011, the PSK1 promoter is deleted to leave 50 bp of the original PSK1 promoter directly in front of ATG of the PSK1 open reading frame. The deletions in the promoter were confirmed by PCR using primers located upstream and downstream of the PSK1 promoter. The deletions in the PSK1 promoter affect the expression levels of the PSK1 open reading frame and consequently, the amounts of produced PSK1 polypeptide vary in the different mutant strains STVP009, STVP010 and STVP011.

Strains STVP007, STVP008, STVP009, STVP010 and STVP011 are constructed with genetic modification techniques known to the person skilled in the art, such as the ones referred or described herein above.

Example 5. Production of Steviol Glycosides in Strains STVP006, STVP007, STVP008, STVP009, STVP010 and STVP011

To establish the effect of the deficiency of PSK1, strains STVP006, STVP007, STVP008, STVP009, STVP010 and STVP011 are cultivated according to the method described in Example 3. After 141 hours of cultivation, the broths are collected for sample preparation and quantification of the steviol glycosides as described in Example 3.

The ratios of the molar concentration of the produced Rebaudioside A, Rebaudioside B, stevioside, steviolbioside and rubusoside (i.e. steviol glycosides with low level of glycosylation) over the molar concentration of the produced Rebaudioside A, Rebaudioside B, Rebaudioside D, Rebaudioside M, stevioside, steviolbioside and rubusoside (referred as "small SGs/Total SGs") are evaluated for strain STVP006 and the PSK1 deficient strains STVP007, STVP008, STVP009, STVP010 and STVP011. The values are normalized to the corresponding values in strain STVP006 which has no deficiency in PSK1.

In the PSK1 deficient strains STVP007, STVP008, STVP009, STVP010 and STVP011, the ratios "Small SGs"/Total SGs" are about 10 to 40%, typically about 20 to 30%, lower than in STVP006.

Therefore, independently of the methods used to render the yeast strains deficient in PSK1, the results show that a deficiency in a PSK in yeast consistently results in improved production of a steviol glycoside, especially rebaudioside M and/or rebaudioside D.

SEQUENCE LISTING (249 sequences)

SEQ ID NO: 1 - DNA, 5175 bp, Artificial Sequence
  Vector construct
aaacaaacgcctgtgggtgtggtactggatatgcaaagcgattggaagtcgcttgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcctggatggcggcgttagtatcgaatcgacagcagtatagcgaccagcattcacatacgattgacgcatgatattactttctgcgcacttaacttcgcatctgggcagatgatgtcgaggcgaaaaaaaatataaatcacgctaacatttgattaaaatagaacaactacaatataaaaaaactatacaaatgacaagttcttgaaaacaagaatctttttattgtcagtactgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccatggttgtttatgttcggatgtgatgtgagaactgtatcctagcaagattttaaaaggaagtatatgaaagaagaacctcagtggcaaatcctaaccttttatatttctctacaggggcgcggcgtggggacaattcaacgcgtctgtgaggggagcgtttccctgctcgcaggtctgcagcgaggagccgtaatttttgcttcgcgccgtgcggccatcaaaatgtatggatgcaaatgattatacatggggatgtatgggctaaatgtacgggcgacagtcacatcatgcccctgagctgcgcacgtcaagactgtcaaggagggtattctgggccttggtatggtgcactctcagtacaatctgctctgatgccgcatagtaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctacttagtatggtctgttggaaaggattgtggcttcgcatacaggctttcttac

SEQ ID NO: 2 - DNA, 50 bp, Artificial Sequence
  connector
aagcgacttccaatcgctttgcatatccagtaccacacccacaggcgttt

SEQ ID NO: 3 - DNA, 1000 bp, Artificial Sequence
  1 kb fragment upstream of PSK1
ctgagatcacgtgctcatccgatatgccggtcggataatatttttggcttgcttccaccaaaattcggtatttaaagaatagaaaaataataataataaaaaacacctactgtaataccgaccaacagggtgatgttagtgcctatcttttgtgggcttatttgaatggaattcatccggcaagtcattagattttttattatcacgtgaaagagctcatcactgtttttttcactctaaaaaaacctacaacatttttcgtttatttattcatttttacccatttctttattttccttttttattttttaatcctaatttatttcatctattttatttcatttaaactctcgagcaatgcttacagaaaactctgactaaaccttcaactaaattagttgtcgtaaatttgaggagaagggagagaagaggaggggagaaaatgatatgtcagaaccgccgactgatcaccaaatccaaacgtcttgttaagcatactccccacccgcggctagtctgctcctcctcctgcttagttaccatcccctctcgtgttctttgttcgtttctcccgccccattatgcgcgtctatcatgtgtctgggtgggtgggtcgacagaacacgagacgagccgatgagtcagacgagccgagggggaggagctgtggcttagtcagagtcacgtggcactatagagcgtttttgctgactcatcacacccctcggcccgcttacaaaaaaacccggccatacatttctctccatatcctagtcgcaccatacactaagttcgataagtttgagcggtggtgtaaaaagtttgggtgcatacaagttgacatctcaaccacctaaattgtgacggaaaaatctcgtggaaaaacaacgacacaaaaacgacacaaaaacaacgaaaaaaggacaagaaaaaggacacagcaaacctgatccccttttcgttacacaaaaccgactccttgttacacaaacatacacgt

SEQ ID NO: 4 - DNA, 50 bp, Artificial Sequence
  connector
acgctttccggcatcttccagaccacagtatatccatccgcctcctgttg

SEQ ID NO: 5 - DNA, 404 bp, Artificial Sequence
  promoter in front of HYG
ctaccgttcgtataatgtatgctatacgaagttatgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaca

SEQ ID NO: 6 - DNA, 1020 bp, Artificial Sequence
  gene encoding resistance against hygromycin
atgcccgagctgaccgccacctccgtcgagaagttcctcattgagaagttcgactccgtttccgatctcatgcagctctccgagggtgaggagtcccgagccttctccttcgatgtcggtggtcgaggctacgttctccgagtcaactcttgtgccgacggtttctacaaggaccgatacgtctaccgacactttgcctccgctgctctccccatccccgaggttctcgacattggtgagttctctgagtctctgacctactgcatctcccgacgagcccagggtgtcactctccaggatctccccgagactgagctgcccgctgttctccagcccgttgccgaggctatggatgccattgctgctgccgatctgtcccagacctccggtttcggccccttcggtccccagggtatcggtcagtacaccacctggcgagacttcatctgtgccatcgccgacccccacgtctaccactggcagaccgtcatggacgacactgtctctgcttccgtcgcccaggctctcgacgagctgatgctctgggccgaggactgccccgaggtccgacacctcgtccacgccgactttggctccaacaacgttctcaccgacaacggccgaatcaccgccgtcatcgactggtccgaggccatgttcggtgactcccagtacgaggttgccaacatcttcttctggcgaccctggctcgcctgcatggagcagcagacccgatactttgagcgacgacaccccgagctggccggctctccccgactccgagcctacatgctccgaatcggtcttgaccagctctaccagtctctcgtcgacggtaacttcgacgacgccgcctgggctcagggccgatgcgacgccattgtccgatccggtgctggcaccgtcggccgaacccagatcgcccgacgatctgctgccgtctggaccgacggctgtgtcgaggttctggccgactccggcaaccgacgaccttccacccgaccccgagccaaggagtaa

SEQ ID NO: 7 - DNA, 286 bp, Artificial Sequence
  terminator behind HYG
atcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcataacttcgtataatgtatgctatacgaacggtac

SEQ ID NO: 8 - DNA, 50 bp, Artificial Sequence
  connector
aacgttgtccaggtttgtatccacgtgtgtccgttccgccaatattccgc

SEQ ID NO: 9 - DNA, 1000 bp, Artificial Sequence
  1 kb fragment downstream of PSK1
tgatgggaggagaactgaacggagatatccgcatctcgaaggtggcatgtcgacggccacaaccgtgtgaccagagatggttcatgttgacggaaatcaaccacgtgactcggaactgtctgtttctgtccgtctttctgttgcctctactagatgtagaatagacactagcgaaaatgcattatttatatgatcaggttgtagacttgtaggtggtgcgggagtggggataaagtggattgttttttgtttttttttcaactttttttcaacttttttttcaactcgaaaaaataccaaacaataccaatgttgtgtcttatagcccgctttataccgccaaaatcagaagacaattgcgactcccattaccatactatttttgatctcgtcaccaaaaatttggaactttttctcgtcaaaaaaaaaaaaaaagtcaaataaatgaacaaataaatgaacaaataaatgaacaaataaatgaacaaataaatgaacaaataatggaaccaactacacaattcgcacaccccattcgatcctgaatcgattgatgtatatattatgtcagttcttcactcagtatctcgagaaccaagactaaagcgaatctaaacgtacagtttacaactcggaaggatgctccagaaataggaaagattttttaataatatcaattaatatggagacttgtatattctctgtactttacaaaaattctagtagatagatgtacttttttaccgacatttcatatcttttgtggctttccagacgaggactaaacgtctgagaagtgaagaataaaatcatcctatattgcccaattcacaacagaattacaactggacttgattattggaaaaccctgattgtttttatcataattatcaactctggaaccgaacatgttaattagatcacgaaatatccaatgtgttccattctgaaggctcgcatgcgcagttttcacaattccaccaccaacgctctgaagata

SEQ ID NO: 10 - DNA, 50 bp, Artificial Sequence
  50 bp connector
agaaagcctgtatgcgaagccacaatcctttccaacagaccatactaagt

SEQ ID NO: 11 - DNA, 71 bp, Artificial Sequence
  PCR primer
aagcgacttccaatcgctttgcatatccagtaccacacccacaggcgtttctgagatcacgtgctcatccg

SEQ ID NO: 12 - DNA, 77 bp, Artificial Sequence
  PCR primer
caacaggaggcggatggatatactgtggtctggaagatgccggaaagcgtacgtgtatgtttgtgtaacaaggagtc

SEQ ID NO: 13 - DNA, 21 bp, Artificial Sequence
  PCR primer
acgctttccggcatcttccag

SEQ ID NO: 14 - DNA, 20 bp, Artificial Sequence
  PCR primer
gcggaatattggcggaacgg

SEQ ID NO: 15 - DNA, 71 bp, Artificial Sequence
  PCR primer
aacgttgtccaggtttgtatccacgtgtgtccgttccgccaatattccgctgatgggaggagaactgaacg

SEQ ID NO: 16 - DNA, 72 bp, Artificial Sequence
  PCR primer
acttagtatggtctgttggaaaggattgtggcttcgcatacaggctttcttatcttcagagcgttggtggtg

SEQ ID NO: 17 - DNA, 21 bp, Artificial Sequence
  PCR primer
ctgagatcacgtgctcatccg

SEQ ID NO: 18 - DNA, 23 bp, Artificial Sequence
  PCR primer
gtcggccagaacctcgacacagc

SEQ ID NO: 19 - DNA, 23 bp, Artificial Sequence
  PCR primer
tgaccgccacctccgtcgagaag

SEQ ID NO: 20 - DNA, 22 bp, Artificial Sequence
  PCR primer
tatcttcagagcgttggtggtg

SEQ ID NO: 21 - DNA, 20 bp, Artificial Sequence
  PCR primer
tcccactaatcacccgttgc

SEQ ID NO: 22 - DNA, 23 bp, Artificial Sequence
  PCR primer
caacaggaggcggatggatatac

SEQ ID NO: 23 - DNA, 22 bp, Artificial Sequence
  PCR primer
aacgttgtccaggtttgtatcc

SEQ ID NO: 24 - DNA, 23 bp, Artificial Sequence
  PCR primer
gggttgttcggattgtagagttc

SEQ ID NO: 25 - DNA, 4302 bp, Artificial Sequence
  PSK1 ORF
atggcccccaccgaccacaatgaagccggcgctacaatgccacaggtgtgtggagacgagtgtctggatgagattgtaagggtcaagtgtgaggagaagccttgtaggtgagttataaggagtcttgggtggtccgagagctgccccaggtgtctgagccaaaggtgagggcatgacggtgatggtgtggttacaacgcgggtggtgtcatggacatgacagtggtggtatggttacatcgccgctggtgtcgtgggcatgacgtgggtggtgtcgtgatgacgtgggtaatgtcgtgggtaatgtcgtgggcatgtcgtgggcaaggtgtggcctcgtgacaacatgggcacgtttggctaacggtcgccaaccgtcgctgccagtcgccaacagcctgatggcgtatgacgatgagtcgccgaagctggcttgtgttgacaatctgctctgttctggcgtttgttgatacttctacatcaactctgtgctgtggttgttccgttgagctggtcgggtcgggtcagccggcccgaaagccccctccccctacagcgacaccgtcggtcagcgacatgttctgtactgggttcacggcgtatcgtcgagccctgcgacgtcgcacagccacgactcagccttcgagacagaagagacagtggagacacccttaagggcacgttcagaaagttcagattgttccgacattcaacttactctagttcggaaaaatgtcgttcaatattgcccgcttcggtgtactgtctcagacttgtgggagccgtccacggctttgtggtcgtgcactgtctatccgtttctgctgcagtcactacactgccctgtcgtcattacactgccctgtcgttgacaccactactgccctgtcgctacctactgctgatatcaccaacctcgctctcgcatctagcttcttttctctttaccaactaacacagaatcgagctcccctccaacatgctctcctccaactcctcctctgcggcagaatccctgcaatccttctcctacgcttacgtgtcccattccgggctctcttcccgcatggctctcatcaagcgagccatccagttcctccgagaacactcgacggagatttcagaaacgtcgtcagccctgaccgacttttttgtctcccatcagcatgaagttgagccctacacacacgccatgggcattccgttttcgtccatccagcgcaatctgtcgaccgccagcatgacggactttttcagcaccttgcccaaacggcagactggtggcgacgaccagggtctgagaggactgctttcgttgctggaaaaccgacatggagatacgcgcagatcgctgagccagggcgtacgccctctagatacgtcacgtgaattgtcacgtgaattggacgacgcgccggccgacggcatgcagtcgcgtgcgctcaaaccagtggcgtctgcggtggaagtttcggcggagtcgcaagattctgagtcgcaaggtgatgggtcgcgtgagcccggggaaccttctggcgaatcgcgcgacgccgactcgactctgctcggatctccgatcaaagccagtgcactcaagccacgaacaacgtcgtggtccgagtccgaggacgacgaagagggtttgtcgttcacgcccaagcgcatgagtcagcagaatctcgcgcccaagctcctggagcagctgacccatcacactcctcggtcggtttcttcgccgctctccaaagaggtcctgagtggctcctcgggctcgtctccggcgtcgtcgtctccctccattaagcggacccggacgctgaccaacacttcgtcgctttctctgcaggctaagctgctggactttttggccgaacctttccaagacaaggctcttcagcccatcaccagaagtgccaccatgttggacgtgtcgagtgccccggaacagatgggcggcggctcggcgggtcacatgggcagtggcagtggcggcgtgagttctgcgggctcctggctacccagcaacgtggagttgcagcctccggtgaccacgcccaacttggcctcttccaagtcaaccactggtctcggcttgttgaccgggaccatggcgcggtattcggcgtcgcaggttgtggtgacgacagccgacaaggctccgtatgagatccgggccgtcaacgacgtggcttgtctggtgtttggcgtgtcacgtgctgagctgcggaacacgtcgattctgaacatggctcgtgacgacatgcgggacgagttgaccgcggagttggctgcggcactgaccaagcccagctcggtggccatttgtggcatggtcattcctgtggtcaagggcaaccgtcaagagtcgttggcgtcaatctgggtgaaaaagtcgcagggcgcgctcatctgggtggccgaggaggttgctggcgatcatgtggaggtggtcatgaagaagcgtgaccctgaggtggtggagaccattggtggagatcgtaacattctgtttggccagcatgattgggcctcctacggcgatatcaagcgaaagatgttgattcggagtgttggtgatggaaatgaggacggtggtagtttcaacggttctgttggttctgtcggttctgtcggtcctgtcggttctggtgattccagcgaatctgccgccgcccaccccttcctttccaacatcacctactcatacaccaccaaagccggaccgtacgactacccgtgcattgtgcgcaaggaaaagaacacatttcacatcacctctctgccgcacatgtcgggcatggtgatggtggactcgtcgactcttgacatcaccgattacaacgccttttttgtgcagtatctgtttggtcatagcagcaagtcgcggtctctgattggacaacacatttccgtcctgttgccgcatatgagcgagtacattgacgagatcaagcgcagcaacaactcgttgggcctgggcatggtttatccggagcattttttccgacgaatggcatcttctggcgacgataaacgcatgacatttttttcatcgattggaattgatggtcggcatttgaacggtgccacgctcaaaattgattgtcagctccgcgtcgcgtccacgagccagttttctctgtggatttcgttttcgcgccacattcaagaggcccatgagattttttccattccgtctcagttgccgctattgaacgagcgcaagcgaaccgagggggaggattcgggaagcgactccagcggcggaagctccagcatggcccattctcgagaaagctcgttgggcgacactgacacgtctgtcagcgagcttcgggaaaagtcggtgtatggtctgaagaacgagtcgcaaaagtccttggcttcaacgcggtctctagaggctgacggctctgtttccgaggccgatggctcgtcgtcgactctggctgcggcggaaatctccgagcttcgaggagtcaccgagattggagcccacaagcgggatcgcaagtttgcggactttcgggttgtgaaaaaaatgggtgaaggcgcttatgggcgggtggtgctggcgcggtaccccgatgatcccgcctgtctgattgtggtcaagtctgtggtcaaggaccgcattttggtggacacgtgggtgcgggatcgaaagcttggcaccgtgtcatctgaaatcaagattctggctgctctcaaccagactccgcatcccaacattgtgggcatggtcgactttctggaggatgatgagtgttaccatatagagatggaggcgcatggcaatcccggcatcgatttgtttgacttgattgaactgaacccgcagatgcccgaggctgagtgcaaatctattttccgccagattgtgtctgccgtggcgcatctacacgggcttggaatcgtgcaccgggacattaaggacgagaatatcattctcgacggcaaggggcttctcaagttgatcgactttggctcggcggcatatgtcaagaacggcccctttgacgtgtttgtgggcactattgattacgccgcccccgaggtgctcagtggcaacccctatctggggcggcctcaggatgtgtgggctctgggcattttgttgtacaccattgtgtacaaggagaatcccttttataacgtggatgagattctggagggcgagttgcgggtgccgtttgtcatgtccgatgattgtttggacttgatacggatgattctcaacagagacgtgaacaagcggcccaccgttgaacagattcgcgatcatccgtggttgcgggagtga

SEQ ID NO: 26 - protein, 1149 aa, Artificial Sequence
  PSK1 PRT
MAPTDHNEAGATMPQVCGDECLDEIVRVKCEEKPCRIELPSNMLSSNSSSAAESLQSFSYAYVSHSGLSSRMALIKRAIQFLREHSTEISETSSALTDFFVSHQHEVEPYTHAMGIPFSSIQRNLSTASMTDFFSTLPKRQTGGDDQGLRGLLSLLENRHGDTRRSLSQGVRPLDTSRELSRELDDAPADGMQSRALKPVASAVEVSAESQDSESQGDGSREPGEPSGESRDADSTLLGSPIKASALKPRTTSWSESEDDEEGLSFTPKRMSQQNLAPKLLEQLTHHTPRSVSSPLSKEVLSGSSGSSPASSSPSIKRTRTLTNTSSLSLQAKLLDFLAEPFQDKALQPITRSATMLDVSSAPEQMGGGSAGHMGSGSGGVSSAGSWLPSNVELQPPVTTPNLASSKSTTGLGLLTGTMARYSASQVVVTTADKAPYEIRAVNDVACLVFGVSRAELRNTSILNMARDDMRDELTAELAAALTKPSSVAICGMVIPVVKGNRQESLASIWVKKSQGALIWVAEEVAGDHVEVVMKKRDPEVVETIGGDRNILFGQHDWASYGDIKRKMLIRSVGDGNEDGGSFNGSVGSVGSVGPVGSGDSSESAAAHPFLSNITYSYTTKAGPYDYPCIVRKEKNTFHITSLPHMSGMVMVDSSTLDITDYNAFFVQYLFGHSSKSRSLIGQHISVLLPHMSEYIDEIKRSNNSLGLGMVYPEHFFRRMASSGDDKRMTFFSSIGIDGRHLNGATLKIDCQLRVASTSQFSLWISFSRHIQEAHEIFSIPSQLPLLNERKRTEGEDSGSDSSGGSSSMAHSRESSLGDTDTSVSELREKSVYGLKNESQKSLASTRSLEADGSVSEADGSSSTLAAAEISELRGVTEIGAHKRDRKFADFRVVKKMGEGAYGRVVLARYPDDPACLIVVKSVVKDRILVDTWVRDRKLGTVSSEIKILAALNQTPHPNIVGMVDFLEDDECYHIEMEAHGNPGIDLFDLIELNPQMPEAECKSIFRQIVSAVAHLHGLGIVHRDIKDENIILDGKGLLKLIDFGSAAYVKNGPFDVFVGTIDYAAPEVLSGNPYLGRPQDVWALGILLYTIVYKENPFYNVDEILEGELRVPFVMSDDCLDLIRMILNRDVNKRPTVEQIRDHPWLRE

SEQ ID NO: 27 - DNA, 1575 bp, Artificial Sequence
  Truncated 3-hydroxy-3-methylglutaryl coenzyme A reductase
atggaccaattggtcaagactgaagtcaccaagaaatctttcactgctccagtccaaaaggcttccactccagttttgaccaacaagaccgtcatctccggttccaaggttaaatctttgtcctctgctcaatcttcctcctctggtccatcttcttcttctgaagaagatgattccagagatatcgaatctttggacaagaaaatcagaccattggaagaattggaagctctattgtcctctggtaacactaagcaattaaagaacaaggaagttgctgctttggttatccacggtaaattgccattgtacgctttggaaaagaaattaggtgacaccaccagagctgttgctgtcagaagaaaggctttgtccattttggctgaagctccagtcttggcttccgacagattaccatacaagaactacgactacgaccgtgtctttggtgcttgttgtgaaaatgtcattggttacatgccattaccagttggtgtcattggtccattggttatcgacggtacttcttaccacatcccaatggctaccactgaaggttgtttggttgcttctgccatgagaggttgtaaggccatcaacgctggtggtggtgctaccaccgttttgactaaggatggtatgaccagaggtcctgttgtcagattcccaactttgaagagatctggtgcttgtaagatctggttggattctgaagaaggtcaaaacgccatcaagaaggctttcaactccacttccagattcgctagattgcaacacattcaaacttgtttagctggtgacttgttgttcatgagattcagaaccaccactggtgacgctatgggtatgaacatgatctccaagggtgttgaatactctttgaagcaaatggttgaagaatacggttgggaagatatggaagttgtctctgtttctggtaactactgtaccgacaagaagccagctgccatcaactggatcgaaggtcgtggtaagtccgttgttgctgaagctaccattccaggtgacgttgtcagaaaggttttgaaatctgatgtttctgctttagtcgaattgaacattgccaagaacttggtcggttctgccatggctggttccgtcggtggtttcaacgctcatgccgctaacttggtcactgctgttttcttggctttaggtcaagatccagctcaaaatgtcgaatcctctaactgtatcactttgatgaaggaagttgacggtgatttgagaatttctgtttccatgccatccattgaagtcggtactatcggtggtggtactgtcttggaaccacaaggtgccatgttggacttgttgggtgttcgtggtccacacgctaccgctccaggtactaacgccagacaattggccagaattgttgcctgtgccgtcttggctggtgaattgtctctatgtgccgctttggctgctggtcacttggttcaatctcacatgacccacaacagaaagcctgctgaaccaaccaaaccaaacaacttggatgctactgacattaacagattaaaggacggttctgtcacctgtatcaagtct

SEQ ID NO: 28 - DNA, 1005 bp, Artificial Sequence
  Variant Geranylgeranyl diphosphate synthase
atggaagctaagattgacgaattgatcaacaacgaccctgtctggtcctctcaaaacgaatctttgatctccaagccatacaaccacatcttgttgaagccaggtaagaacttcagattaaacttgattgttcaaatcaacagagttatgaacttgccaaaggaccaattggccattgtttcccaaattgtcgaattgttgcacaactcctctctattgatcgatgacattgaagataatgctccattaagaagaggtcaaaccacttctcatttgattttcggtgtcccatccaccatcaacactgctaactacatgtacttcagagccatgcaattggtttctcaattgaccaccaaggaaccattataccacaacttgatcactatctttaacgaagaattgattaacttgcaccgtggtcaaggtttggacatctactggagagatttcttgccagaaattattccaactcaagaaatgtacttgaacatggtcatgaacaagactggtggtttattcagattgactttacgtttgatggaagctttgtctccatcttcccaccacggtcactctttggttccattcatcaatctattaggtatcatctaccaaatcagagatgattacttgaacttgaaggacttccaaatgtcctctgaaaagggtttcgctgaagatatcactgaaggtaaattgtctttcccaattgtccacgccttgaactttaccaagaccaagggtcaaactgaacaacacaacgaaattttgagaatcttattgttgagaacttctgacaaggacatcaagttgaaattgatccaaatcttggaattcgataccaactctttggcttacaccaagaacttcatcaaccaattggttaacatgatcaagaatgacaacgaaaacaaatacttgccagacttggcttcccactccgataccgctaccaacttgcacgacgaattgttgtacattattgaccatttgtctgagtta

SEQ ID NO: 29 - DNA, 2552 bp, Artificial Sequence
  Copalyl diphosphate synthase
cccactagttataaagtcacaagtatctcagtatacccgtctaaccacacatttatcaccatgtgcaaggctgtttccaaggagtactccgatctgctccagaaggacgaggcctctttcaccaagtgggacgacgacaaggtcaaggaccacctcgacaccaacaagaacctctaccccaacgacgagatcaaggagtttgtcgagtccgtcaaggccatgttcggctccatgaacgacggcgagattaatgtctctgcttacgacaccgcctgggttgctctggtccaggatgtcgacggttccggctctcctcagttcccttcctctctcgagtggatcgccaacaaccagctgtccgacggttcttggggtgaccacctgctcttctctgctcacgaccgaatcatcaacaccctggcctgtgtcattgctctgacctcttggaacgtccacccctccaagtgcgagaagggtctgaacttcctccgagagaacatctgcaagctcgaggacgagaacgccgagcacatgcccattggcttcgaggtcaccttcccctctctgattgacattgccaagaagctcaacattgaggtccccgaggacacccccgctctcaaggagatctacgctcgacgagacatcaagctcaccaagatccccatggaggttctccacaaggtccccaccactctcctccactctctcgagggtatgcccgatctcgagtgggagaagctgctcaagctgcagtgcaaggacggctctttcctcttctccccctcttccactgccttcgccctcatgcagaccaaggacgagaagtgtctccagtacctcaccaacattgtcaccaagttcaacggtggtgtccccaacgtctaccccgttgacctctttgagcacatctgggttgttgaccgactccagcgactcggtatcgcccgatacttcaagtccgagatcaaggactgtgtcgagtacatcaacaagtactggaccaagaacggtatctgctgggcccgaaacacccacgtccaggacattgacgacaccgccatgggcttccgagttctgcgagcccacggctacgatgtcacccccgatgtctttcgacagtttgagaaggacggcaagtttgtctgtttcgccggtcagtccacccaggccgtcaccggtatgttcaacgtctaccgagcttctcagatgctcttccccggtgagcgaatcctcgaggacgccaagaagttctcctacaactacctcaaggagaagcagtccaccaacgagctgctcgacaagtggatcattgccaaggatctgcccggtgaggttggctacgccctcgacatcccctggtacgcctctctgccccgactggagactcgatactacctcgagcagtacggtggtgaggacgatgtctggatcggtaagaccctgtaccgaatgggctacgtttccaacaacacctacctcgagatggccaagctcgactacaacaactacgttgccgtcctccagctcgagtggtacaccatccagcagtggtacgtcgacattggtatcgagaagttcgagtccgacaacatcaagtccgtccttgtctcctactacctcgctgctgcctccatcttcgagcccgagcgatccaaggagcgaattgcctgggccaagaccaccatcctcgtcgacaagatcacctccatcttcgactcctcccagtcctccaaggaagatatcaccgccttcattgacaagttccgaaacaagtcctcctccaagaagcactccatcaacggcgagccctggcacgaggtcatggttgctctcaagaaaactctccacggctttgccctcgacgctctgatgacccactctcaggacatccacccccagctccaccaggcctgggagatgtggctcaccaagctccaggacggtgttgatgtcactgctgagctcatggtccagatgatcaacatgaccgccggccgatgggtttccaaggagctcctcacccacccccagtaccagcgactctccactgtcaccaactctgtctgccacgacatcaccaagctccacaacttcaaggagaactccaccaccgtcgactccaaggtccaggagctggtccagctcgttttctccgacacccccgatgatctcgaccaggacatgaagcagaccttcctgactgtcatgaaaactttctactacaaggcctggtgcgaccccaacaccatcaacgaccacatctccaaggtctttgagattgtgatttaagttttttgatcaatgatccaatggctttcacatacccccccacgcctataattaaaacacagagaaatataatctaacttaataaatattacggagaatctttcgagtgttcagcagaaatatagccattgtaacaaaagccggctatcgaccgctttatcgaagaatatttcccgccccccagtggccaaacgatatcgaaacaaaagagctgaaatcatatccttcagtagtagtatagtcctgttatcacagcatca

SEQ ID NO: 30 - DNA, 2394 bp, Artificial Sequence
  Kaurene synthase
agatatacaagcaatgtcactctccttcgtactcgtacatacaacacaactacattcaaaatgacctcccacggcggccagaccaaccccaccaacctcatcattgacaccaccaaggagcgaatccagaagcagttcaagaacgtcgagatctccgtttcctcctacgacaccgcctgggtcgccatggtcccctctcccaactcccccaagtctccctgcttccccgagtgtctcaactggctcatcaacaaccagctcaacgacggctcttggggtctggtcaaccacacccacaaccacaaccaccccctcctcaaggactctctctcttccactctcgcctgcattgttgctctcaagcgatggaacgttggcgaggaccagatcaacaagggtctgtctttcattgagtccaacctcgcctccgccaccgagaagtcccagccctcccccattggctttgatatcatcttccccggtctgctcgagtacgccaagaacctcgatatcaacctgctctccaagcagaccgacttctctctcatgctgcacaagcgagagctcgagcagaagcgatgccactccaacgagatggacggctacctggcctacatttccgagggtctgggtaacctctacgactggaacatggtcaagaagtaccagatgaagaacggttccgttttcaactccccctctgccaccgctgctgccttcatcaaccaccagaaccccggctgtctcaactacctcaactctctgctcgacaagtttggtaacgccgtccccactgtctacccccacgatctcttcatccgactctccatggtcgacaccattgagcgactcggtatttcccaccacttccgagtcgagatcaagaacgttctcgatgagacttaccgatgctgggttgagcgagatgagcagatcttcatggacgttgtcacctgtgctctggccttccgactcctccgaatcaacggttacgaggtttcccccgaccccctcgccgagatcaccaacgagctggctctcaaggacgagtacgccgccctcgagacttaccacgcttctcacattctgtaccaagaggatctgtcctccggcaagcagattctcaagtccgccgacttcctcaaggagatcatctccactgactccaaccgactctccaagctcatccacaaggaagtcgagaacgctctcaagttccccatcaacaccggtctggagcgaatcaacacccgacgaaacatccagctctacaacgtcgacaacacccgaattctcaagaccacctaccactcttccaacatctccaacaccgactacctgcgactcgccgtcgaggacttctacacctgccagtccatctaccgagaggagctcaagggtctggagcgatgggttgtcgagaacaagctcgaccagctcaagtttgcccgacaaaagactgcctactgctacttctccgttgctgccaccctctcttctcccgagctctccgacgcccgaatctcttgggccaagaacggtatcctgaccactgttgtcgacgacttctttgacattggtggcaccattgacgagctgaccaacctcatccagtgcgtcgagaagtggaacgtcgacgttgacaaggactgttgttccgagcacgtccgaatcctcttcctggctctcaaggacgccatctgctggatcggtgacgaggccttcaagtggcaggctcgagatgtcacttcccacgtcatccagacctggctcgagctcatgaactccatgctgcgagaggccatctggacccgagatgcctacgtccccaccctcaacgagtacatggagaacgcctacgtcagctttgctctcggtcccattgtcaagcccgccatctactttgtcggtcccaagctgtccgaggagattgtcgagtcctccgagtaccacaacctcttcaagctcatgtccacccagggccgactcctcaacgatatccactccttcaagcgagagttcaaggaaggtaagctcaacgccgttgctctgcacctgtccaacggtgagtccggcaaggtcgaggaagaggtcgtcgaggagatgatgatgatgatcaagaacaagcgaaaggagctcatgaagctcatcttcgaggagaacggctccattgtcccccgagcctgcaaggacgccttctggaacatgtgccacgtcctcaacttcttctacgccaacgacgacggtttcaccggcaacaccattctcgacaccgtcaaggacatcatctacaaccctctggttctggtcaacgagaacgaggagcagaggtaactatccgaagatcaagagcgaagcaagttgtaagtccaggacatgtttcccgcccacgcg

SEQ ID NO: 31 - protein, 512 aa, Artificial Sequence
  Kaurene oxidase
MDGVIDMQTIPLRTAIAIGGTAVALVVALYFWFLRSYASPSHHSNHLPPVPEVPGVPVLGNLLQLKEKKPYMTFTKWAEMYGPIYSIRTGATSMVVVSSNEIAKEVVVTRFPSISTRKLSYALKVLTEDKSMVAMSDYHDYHKTVKRHILTAVLGPNAQKKFRAHRDTMMENVSNELHAFFEKNPNQEVNLRKIFQSQLFGLAMKQALGKDVESIYVKDLETTMKREEIFEVLVVDPMMGAIEVDWRDFFPYLKWVPNKSFENIIHRMYTRREAVMKALIQEHKKRIASGENLNSYIDYLLSEAQTLTDKQLLMSLWEPIIESSDTTMVTTEWAMYELAKNPNMQDRLYEEIQSVCGSEKITEENLSQLPYLYAVFQETLRKHCPVPIMPLRYVHENTVLGGYHVPAGTEVAINIYGCNMDKKVWENPEEWNPERFLSEKESMDLYKTMAFGGGKRVCAGSLQAMVISCIGIGRLVQDFEWKLKDDAEEDVNTLGLTTQKLHPLLALINPRK

SEQ ID NO: 32 - DNA, 1698 bp, Artificial Sequence
  Kaurene oxidase
cacacccgaaatcgttaagcatttccttctgagtataagaatcattcgctagccacaaaaatgtccaagtccaactccatgaactccacctcccacgagactctcttccagcagctcgttctcggcctcgaccgaatgcccctcatggacgtccactggctcatctacgttgcctttggtgcctggctctgctcctacgtcatccacgttctgtcctcttcctccactgtcaaggtccccgtcgtcggttaccgatccgttttcgagcccacctggctcctccgactgcgattcgtctgggagggtggttccatcattggccagggctacaacaagttcaaggactccatcttccaggtccgaaagctcggtaccgacattgtcatcatccctcccaactacattgacgaggtccgaaagctctcccaggacaagacccgatccgtcgagcccttcatcaacgactttgccggccagtacacccgaggtatggtctttctgcagtccgatctccagaaccgagtcatccagcagcgactcacccccaagcttgtctctctcaccaaggtcatgaaggaagagctcgactacgctctgaccaaggagatgcccgacatgaagaacgacgagtgggttgaggtcgacatctcttccatcatggtccgactcatctctcgaatctccgcccgagttttcctcggccccgagcactgccgaaaccaggagtggctcaccaccaccgccgagtactccgagtctctcttcatcaccggcttcatcctccgagttgtcccccacattctccgacccttcattgctcctctgctgccctcttaccgaaccctgctgcgaaacgtttcttccggccgacgagtcattggtgatatcatccgatcccagcagggtgacggtaacgaggacatcctctcttggatgcgagatgctgccactggtgaggagaagcagatcgacaacattgcccagcgaatgctcattctgtctctcgcctccatccacaccaccgccatgaccatgacccacgccatgtacgatctgtgtgcctgccccgagtacattgagcccctccgagatgaggtcaagtccgtcgttggtgcttctggctgggacaagaccgctctcaaccgattccacaagctcgactctttcctcaaggagtcccagcgattcaaccccgttttcctgctcaccttcaaccgaatctaccaccagtccatgaccctctccgatggtaccaacatcccctccggtacccgaattgctgtcccctctcacgccatgctccaggactccgcccacgtccccggtcccactcctcccactgagttcgacggtttccgatactccaagatccgatccgactccaactacgcccagaagtacctcttctccatgaccgactcttccaacatggcctttggctacggtaagtacgcctgccccggccgattctacgcctccaacgagatgaagctgactctggccattctgctcctccagtttgagttcaagctccccgacggtaagggccgaccccgaaacatcaccatcgactccgacatgatccccgacccccgagctcgactctgtgtccgaaagcgatctctgcgtgacgagtaagctatttacagcatgtgtaatgaggaatataacgttgattgaattgtttgtgaaaaatgt

SEQ ID NO: 33 - DNA, 1698 bp, Artificial Sequence
  Kaurenoic acid 13- hydroxylase
ttgaatcttttttcttcttctcttctctatattcattcttgaattaaacacacatcaacaatggagtctctggttgtccacaccgtcaacgccatctggtgcattgtcattgtcggtatcttctccgtcggctaccacgtctacggccgagctgttgtcgagcagtggcgaatgcgacgatctctcaagctccagggtgtcaagggtcctcctccctccatcttcaacggtaacgtttccgagatgcagcgaatccagtccgaggccaagcactgctccggtgacaacatcatctcccacgactactcttcttctctgttcccccactttgaccactggcgaaagcagtacggccgaatctacacctactccactggcctcaagcagcacctctacatcaaccaccccgagatggtcaaggagctctcccagaccaacaccctcaacctcggccgaatcacccacatcaccaagcgactcaaccccattctcggtaacggtatcatcacctccaacggcccccactgggcccaccagcgacgaatcattgcctacgagttcacccacgacaagatcaagggtatggtcggtctgatggtcgagtccgccatgcccatgctcaacaagtgggaggagatggtcaagcgaggtggtgagatgggctgtgacatccgagtcgacgaggacctcaaggatgtctccgctgacgtcattgccaaggcctgtttcggctcttccttctccaagggcaaggccatcttctccatgatccgagatctgctcaccgccatcaccaagcgatccgtcctcttccgattcaacggtttcaccgacatggttttcggctccaagaagcacggtgacgttgacattgacgctctcgagatggagctcgagtcctccatctgggagactgtcaaggagcgagagattgagtgcaaggacacccacaagaaggacctcatgcagctcattctcgagggtgccatgcgatcttgtgacggtaacctgtgggacaagtctgcttaccgacgattcgttgtcgacaactgcaagtccatctactttgccggccacgactccaccgccgtttccgtttcttggtgcctcatgctgctcgctctcaacccctcttggcaggtcaagatccgagatgagattctgtcctcctgcaagaacggtatccccgacgccgagtccatccccaacctcaagaccgtcaccatggtcatccaggagactatgcgactctaccctcccgctcccattgtcggccgagaggcctccaaggacattcgactcggtgatctggttgtccccaagggtgtctgtatctggaccctcatccccgctctgcaccgagatcccgagatctggggtcccgacgccaacgacttcaagcccgagcgattctccgagggtatctccaaggcctgcaagtacccccagtcctacatcccctttggcctcggcccccgaacctgtgtcggcaagaactttggtatgatggaggtcaaggtcctcgtttctctgattgtctccaagttctccttcactctgtctcccacctaccagcactctccctcccacaagctgctcgtcgagccccagcacggtgttgtcatccgagttgtataaacttcgagctaatccagtagcttacgttacccaggggcaggtcaactggctagccacgag

SEQ ID NO: 34 - protein, 525 aa, Artificial Sequence
  Kaurenoic acid 13- hydroxylase
MESLVVHTVNAIWCIVIVGIFSVGYHVYGRAVVEQWRMRRSLKLQGVKGPPPSIFNGNVSEMQRIQSEAKHNSGDNIISHDYSSTLFPHFDHWRKQYGRIYTYSTGLRQHLYINHPEMVKELSQTNSLDLGRITHITKRLAPILGNGIITSNGPHWAHQRRIIAYEFTHDKVKGMVGLMVESAMPMLNKWEEMVEAEGGMGCDIRVDEDLKDVSADVIAKACFGSNFSKGKAIFSKIRDLLTAITKRSVLFRFNGFTDMVFGSKKHGDVDIDALEMELESSIWETVKERERECKDTHKKDLLQLILEGAMRSCDGNLWDKSAYRRFVVDNCKSIYFAGHDSTAVSVSWCLMLLALNPSWQEKIRDEILSSCKNGIPDAESIPNLKTVTMVIQETMRLYPPAPIVGREASKDIRLGDLVVPKGVCIWTLIPALHRDPEIWGPDANDFKPERFSEGISKACKYPQAYIPFGLGPRTCVGKNFGMMEVKVLVSLIVSKFSFTLSPTYQHSPSHKLLVEPQHGVVIRVV

SEQ ID NO: 35 - DNA, 2256 bp, Artificial Sequence
  NADPH-cytochrome P450 reductase
cgtccatatatatctatgctgcgtcgtccttttcgtgacatcaccaaaacacatacaaaaatgtcctcctcttcttcttcttccacctccatgattgatctcatggctgccatcatcaagggtgagcccgtcattgtctccgaccccgccaacgcctccgcctacgagtccgttgctgccgagctgtcctccatgctcatcgagaaccgacagtttgccatgatcgtcaccacctccattgctgttctcattggctgcattgtcatgctcgtctggcgacgatctggctccggtaactccaagcgagtcgagcccctcaagcccctggtcatcaagccccgagaagaggagatcgacgacggccgaaagaaggtcaccatcttctttggcacccagaccggtactgctgagggcttcgccaaggctctcggtgaggaagccaaggctcgatacgaaaagacccgattcaagattgtcgacctcgatgattacgctgccgatgacgacgagtacgaggagaagctcaagaaagaggacgttgccttcttcttcctcgccacctacggtgacggtgagcccaccgacaacgctgcccgattctacaagtggttcaccgagggtaacgaccgaggcgagtggctcaagaacctcaagtacggtgttttcggtctgggcaaccgacagtacgagcacttcaacaaggttgccaaggttgtcgacgacatcctcgtcgagcagggtgcccagcgactcgtccaggtcggcctcggtgatgatgaccagtgcatcgaggacgacttcactgcctggcgagaggctctgtggcccgagctcgacaccattctgcgagaggaaggtgacaccgccgttgccaccccctacaccgccgccgtcctcgagtaccgagtctccatccacgactccgaggatgccaagttcaacgacatcaacatggccaacggtaacggctacaccgtctttgacgcccagcacccctacaaggccaacgtcgccgtcaagcgagagctccacacccccgagtccgaccgatcttgtatccacctcgagtttgacattgctggttccggtctgacctacgagactggtgaccacgttggtgtcctctgtgacaacctgtccgagactgtcgacgaggctctgcgactcctcgacatgtcccccgacacttacttctctctgcacgccgagaaagaggacggtactcccatctcttcttctctgccccctcccttccctccctgcaacctgcgaaccgctctgacccgatacgcctgcctcctctcttctcccaagaagtctgctctcgttgctctggccgcccacgcctccgaccccaccgaggctgagcgactcaagcacctcgcctctcccgctggcaaggacgagtactccaagtgggttgtcgagtcccagcgatctctgctcgaggtcatggccgagttcccctccgccaagccccctctcggtgttttcttcgccggtgttgctccccgactccagccccgattctactccatctcctcttcccccaagatcgccgagactcgaatccacgttacctgtgctctggtctacgagaagatgcccaccggccgaatccacaagggtgtctgctccacctggatgaagaacgccgttccctacgagaagtccgagaactgttcctctgctcccatctttgtccgacagtccaacttcaagctcccctccgactccaaggtccccatcatcatgattggccccggtaccggcctcgcccccttccgaggcttcctgcaggagcgactcgccctcgtcgagtccggtgtcgagctcggcccctccgtcctcttctttggctgccgaaaccgacgaatggacttcatctacgaagaggagctccagcgattcgtcgagtccggtgctctcgccgagctctccgttgccttctcccgagagggtcccaccaaggagtacgtccagcacaagatgatggacaaggcctccgacatctggaacatgatctcccagggcgcctacctctacgtctgcggtgacgccaagggtatggcccgagatgtccaccgatctctgcacaccattgcccaggagcagggctccatggactccaccaaggccgagggtttcgtcaagaacctccagacctccggccgatacctccgagatgtctggtaaaattaacagatagtttgccggtgataattctcttaacctcccacactcctttgacataac

SEQ ID NO: 36 - DNA, 1566 bp, Artificial Sequence
  UDP-glucosyltransferase
cccactagttataaagtcacaagtatctcagtatacccgtctaaccacacatttatcaccatggacgccatggccaccaccgagaagaagccccacgtcatcttcatccccttccccgcccagtcccacatcaaggccatgctcaagctcgcccagctcctccaccacaagggcctccagatcacctttgtcaacaccgacttcatccacaaccagttcctcgagtcctccggcccccactgtctggacggtgctcccggtttccgatttgagactatccccgatggtgtctcccactcccccgaggcctccatccccatccgagagtctctgctccgatccattgagactaacttcctcgaccgattcattgatctcgtcaccaagctccccgatcctcccacctgtatcatctccgacggtttcctgtccgttttcaccattgatgctgccaagaagctcggtatccccgtcatgatgtactggactctggctgcctgtggtttcatgggtttctaccacatccactctctgatcgagaagggctttgctcctctcaaggacgcctcctacctcaccaacggttacctcgacaccgtcattgactgggtccccggtatggagggtatccgactcaaggacttccccctcgactggtccaccgacctcaacgacaaggttctcatgttcaccaccgaggctccccagcgatcccacaaggtttcccaccacatcttccacaccttcgacgagctcgagccctccatcatcaagactctgtctctgcgatacaaccacatctacaccattggccccctccagctcctcctcgaccagatccccgaggagaagaagcagaccggtatcacctctctgcacggctactctctcgtcaaggaagagcccgagtgcttccagtggctccagtccaaggagcccaactccgttgtctacgtcaactttggctccaccaccgtcatgtctctcgaggacatgaccgagtttggctggggtctggccaactccaaccactacttcctgtggatcatccgatccaacctcgtcattggcgagaacgccgttctgcctcccgagctcgaggagcacatcaagaagcgaggcttcattgcctcttggtgctcccaggagaaggttctcaagcacccctccgtcggtggtttcctgacccactgcggctggggctccaccattgagtctctgtccgctggtgtccccatgatctgctggccctactcctgggaccagctcaccaactgccgatacatctgcaaggagtgggaggttggtctggagatgggtaccaaggtcaagcgagatgaggtcaagcgactcgtccaggagctcatgggcgagggtggtcacaagatgcgaaacaaggccaaggactggaaggagaaggcccgaattgccattgcccccaacggctcttcttctctcaacattgacaagatggtcaaggagatcactgttctcgctcgaaactaactatccgaagatcaagagcgaagcaagttgtaagtccaggacatgtttcccgcccacgcg

SEQ ID NO: 37 - DNA, 1542 bp, Artificial Sequence
  UDP-glucosyltransferase
cgtccatatatatctatgctgcgtcgtccttttcgtgacatcaccaaaacacatacaaaaatggccacctccgactccattgtcgacgaccgaaagcagctgcacgttgccaccttcccctggctcgcctttggccacattctgccctacctccagctctccaagctcattgctgagaagggccacaaggtttctttcctgtccaccacccgaaacatccagcgactctcctcccacatctctcctctcatcaacgttgtccagctcaccctcccccgagtccaggagctccccgaggatgccgaggccaccactgatgtccaccccgaggacatcccctacctcaagaaggcctccgacggtctgcagcccgaggtcacccgattcctcgagcagcactctcccgactggatcatctacgactacacccactactggctcccctccattgctgcttctctcggtatctctcgagcccacttctccgtcaccaccccctgggccattgcttacatgggcccctctgctgacgccatgatcaacggttccgacggccgaaccaccgtcgaggatctcaccacccctcccaagtggttccccttccccaccaaggtctgctggcgaaagcacgatctcgcccgactcgtcccctacaaggcccccggtatctccgacggttaccgaatgggtctggttctcaagggctccgactgtctgctctccaagtgctaccacgagtttggtacccagtggctccccctgctcgagactctgcaccaggtccccgttgtccccgtcggtctgctccctcccgagatccccggtgacgagaaggacgagacttgggtttccatcaagaagtggctcgacggcaagcagaagggctccgtcgtctacgttgctctcggctccgaggttcttgtctcccagactgaggtcgtcgagctcgccctcggtctggagctctccggtctgcccttcgtctgggcctaccgaaagcccaagggtcccgccaagtccgactccgtcgagctccccgacggtttcgtcgagcgaactcgagatcgaggtctggtctggacctcttgggctccccagctccgaatcctctcccacgagtccgtctgcggtttcctgacccactgtggttccggctccattgtcgagggcctcatgttcggccaccccctcatcatgctgcccatcttcggtgaccagcccctcaacgcccgactcctcgaggacaagcaggtcggtatcgagatcccccgaaacgaagaggacggctgcctcaccaaggagtctgttgcccgatctctgcgatctgttgttgtcgagaaagagggtgagatctacaaggccaacgcccgagagctctccaagatctacaacgacaccaaggtcgagaaggagtacgtttcccagtttgtcgactacctcgagaagaacgcccgagctgtcgccattgaccacgagagttaaaattaacagatagtttgccggtgataattctcttaacctcccacactcctttgacataac

SEQ ID NO: 38 - DNA, 1392 bp, Artificial Sequence
  UDP-glucosyltransferase
atggacaacaaccatttgggtgaaactttgttgccattggctccaaagaacggtagaagagtcttgttcttcccatacccattacaaggtcacatttctccaatgttgaacttggccaacttgttgcactccaagggtttcaccatcaccatcatccacaccaatttgaactctccaaaccaatctgactacccacacttcactttcagaccatttgatgacggtttcccaccatactccaagggttggcaattggctaccttgtgttccagatgtgttgaaccattcagagaatgtttggctcaaatcttcttgtctgaccacactgctccagaaggtgaaagagaatctattgcttgtttgattgctgatggtttatggaacttcttgggtgctgctgtctacaactttaaattgccaatgattgttttgagaactggtaacatgtctaacattgttgccaacgttaagttgccatgtttcatcgaaaagggttacttcgaccataccaaggaaggttccaagttggaagctgctgtcccagaattcccaaccatcaagttcaaagatatcttgaaaacctacggttctaacccaaaggccatctgtgaaactttgactgctttgttgaaggaaatgagagcttcttctggtgtcatctggaactcttgtaaggaattagaacaatctgaattacaaatgatctgtaaggaattcccagttcctcatttcttgattggtcctttgcacaaatacttcccagcttcttcttcttccttggttgcccacgacccatcttccatttcctggttgaactccaaggctccaaactctgttttgtacgtttctttcggttccatctcttccatggacgaagctgaatttctagaaactgcttggggtttggccaactccatgcaacaattcttatgggttgtcagaccaggttctgtcagaggttctcaatggttggaatctttaccagatggtttcattgacaagttggatggtagaggtcacattgtcaaatgggctcctcaacaagaagtcttagctcaccaagctaccggtggtttctggactcactgtggttggaactccactttagaatccatgtgtgaaggtgtcccaatgatttgttcccacggtatcatggaccaaccaatcaatgctcgttacgttaccgatgtctggaaggttggtattgaattggaaaagggttttgactctgaagaaatcaagatggccatccgtcgtttgatggttgacaaggaaggtcaagaaatcagagaaagatcttccagattgaaggaatctttgtccaactgtttgaagcaaggtggttcttcccacgattctgtcgaatctttggttgaccacatcctatccttc

SEQ ID NO: 39 - DNA, 1497 bp, Artificial Sequence
  UDP-glucosyltransferase
cacacccgaaatcgttaagcatttccttctgagtataagaatcattcgctagccacaaaaatggagaacaagaccgagactaccgtccgacgacgacgacgaatcattctcttccccgtccccttccagggccacatcaaccccattctgcagctcgccaacgttctgtactccaagggcttctccatcaccatcttccacaccaacttcaacaagcccaagacctccaactacccccacttcactttccgattcatcctcgacaacgacccccaggacgagcgaatctccaacctgcccacccacggtcctctggctggtatgcgaatccccatcatcaacgagcacggtgctgacgagctccgacgagagctcgagctgctcatgctcgcctccgaagaggacgaggaagtctcctgtctgatcaccgatgctctgtggtactttgcccagtccgtcgccgactctctcaacctgcgacgactcgttctcatgacctcctctctgttcaacttccacgcccacgtttctctgccccagtttgacgagctcggttacctcgaccccgatgacaagacccgactcgaggagcaggcttccggtttccccatgctcaaggtcaaggacatcaagtccgcctactccaactggcagattctcaaggagattctcggcaagatgatcaagcagaccaaggcctcctccggtgtcatctggaactccttcaaggagctcgaggagtccgagctcgagactgtcatccgagagatccccgctccctctttcctcatccccctgcccaagcacctcaccgcttcctcctcttctctgctcgaccacgaccgaaccgtctttcagtggctcgaccagcagcccccttcctccgtcctctacgtttccttcggctccacctccgaggtcgacgagaaggacttcctcgagattgctcgaggcctcgttgactccaagcagtccttcctgtgggttgtccgacccggctttgtcaagggctccacctgggttgagcccctgcccgatggtttcctcggtgagcgaggccgaattgtcaagtgggtcccccagcaggaagttctggcccacggtgccattggtgccttctggacccactccggctggaactccactctcgagtccgtctgcgagggtgtccccatgatcttctccgactttggcctcgaccagcccctcaacgcccgatacatgtccgatgttctcaaggtcggtgtctacctcgagaacggctgggagcgaggtgagattgccaacgccatccgacgagtcatggtcgacgaggaaggtgagtacatccgacagaacgcccgagtcctcaagcagaaggccgatgtctctctcatgaagggtggttcttcttacgagtctctcgagtctctcgtttcctacatctcttctttgtaagctatttacagcatgtgtaatgaggaatataacgttgattgaattgtttgtgaaaaatgt

SEQ ID NO: 40 - protein, 446 aa, Artificial Sequence
  UDP-glucosyltransferase
MSTTLKVLMFPFLAYGHISPYLNVAKKLADRGFLIYLCSTPINLKSTINKIPEKYADSIQLIELHLPELPELPPHYHTTNGLPPNLNHILRRALKMSKPNFSKIMQNLKPDLLIYDILQQWAEDVATELNIPAVKLLTSGVAVFSYFFNLTKKPEVEFPYPAIYLRKIELVRWCETLSKHNKEGEEHDDGLAYGNMQIMLMSTSKILEAKYIDYCIELTNWKVVPVGSLVQDSITNDAADDDMELIDWLGTKDENSTVFVSFGSEYFLSKEDVEEVAFGLELSNVNFIWVVRFPKGEEKNLEDVLPKGFFERIGERGRVLDKFAPQPRILNHPSTGGFISHCGWNSAMESIDFGVPIVAMPMQLDQPMNARLIVELGVAVEIVRDDDGKIYRGEIAETLKGVITGEIGEILRAKVRDISKNLKAIKDEEMDVAAQELIQLCRNSNK

SEQ ID NO: 41 - DNA, 880 bp, Artificial Sequence
  Promoter
aaacaaaagagctgaaatcatatccttcagtagtagtatagtcctgttatcacagcatcaattacccccgtccaagtaagttgattgggatttttgtttacagatacagtaatatacttgactatttctttacaggtgactcagaaagtgcatgttggaaatgagccacagaccaagacaagatatgacaaaattgcactattcgatgcagaattcgacggtgtttccattggtgttatgacattcatctgcattcatacaaaaaagtcttggtagtggtacttttgcgttattacctccgatatctacgcaccccccaacccccctgctacagtaaagagtgtgagtctactgtacatgcttactaaaccacctactgtacagcgaaacccctcagcaaaatcacacaatcagctcattacaacacacccaatgacctcaccacaaattctatacgccttttgacgccattattacagtagcttgcaacgccgttgtcttaggttccatttttagtgctctattacctcacttaacccgtataggcagatcaggccatggcactaagtgtagagctagaggttgatatcgccacgagtgctccatcagggctagggtggggttagaaatacagtccgtgcgcactcaaaaggcgtccgggttagggcatccgataatatcgcctggactcggcgccatattctcgacttctgggcgcgttgtattcatctcctccgcttcccaacacttccacccgtttctccatcccaaccaatagaatagggtaaccttattcgggacactttcgtcatacatagtcagatatacaagcaatgtcactctccttcgtactcgtacatacaacacaactacattcaaa

SEQ ID NO: 42 - DNA, 1183 bp, Artificial Sequence
  Terminator-Promoter
ctatccgaagatcaagagcgaagcaagttgtaagtccaggacatgtttcccgcccacgcgagtgatttataacacctctcttttttgacacccgctcgccttgaaattcatgtcacataaattatagtcaacgacgtttgaataacttgtcttgtagttcgatgatgatcatatgattacattaatagtaattactgtatggcgcgccggtagtcggaaagagccgggaccggccggcgagcataaaccggacgcagtaggatgtcctgcacgggtctttttgtggggtgtggagaaaggggtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaaagaagcttgggttatattcccgctctatttagaggttgcgggatagacgccgacggagggcaatggcgccatggaaccttgcggatatcgatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaaca

SEQ ID NO: 43 - DNA, 639 bp, Artificial Sequence
  Terminator-Promoter
acttcgagctaatccagtagcttacgttacccaggggcaggtcaactggctagccacgagtctgtcccaggtcgcaatttagtgtaataaacaatatatatattgagtctaaagggaattgtagctattgtgattgtgtgattttcgtcttgctggttcttattgtgtcccattcgtttcatcctgatgaggacccctggcgtacgccggcgaagcttggtaccagagacgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcgctagccacaaaa

SEQ ID NO: 44 - DNA, 1009 bp, Artificial Sequence
  Terminator-Promoter
gctatttacagcatgtgtaatgaggaatataacgttgattgaattgtttgtgaaaaatgtagaaaatttcagtgaagttgtgttttctatatagtaagcacttttggtacaagtatctgcacatccctgcatgttacaagcctgatcatgcagggcaatattctgactataaatatacctcgatattttagcaagctatacgtacgtaccaaccacagattacgacccattcgcagtcacagttcactagggtttgggttgcatccgttgagagtggtttgtttttaaccttctccatgtgctcactcaggttttgggttcagatcaaatcaaggcgtgaaccactgtttgaggacaaatgtgacacaaccaaccagtgtcaggggcaagtccgtgacaaaggggaagatacaatgcaattactgacagttacggactgcctcgatgccctaaccttgccccaaaataagacaactgtcctcgtttaagcgcaaccctattcagcgtcacgtcataatagcgtttggatagcactagtctatgaggagcgttttatgttgcggtgagggcgattggtgctcatatgggttcaattgaggtggtggaacgagcttagtcttcaattgaggtgcgagcgacacaattgggtgtcacgtggcctaattgacctcggatcgtggagtccccagttatacagcaaccacgaggtgcatgagtaggagacgtcaccagacaatagggtttttttggactggagagggtagggcaaaagcgctcaacgggctgtttggggagctatgggggaggaattggcgatatttgtgaggttgacggctccgatttgcgtgttttgtcgcttctgcatctccccatacccatatcttccctccccacctctttccacgataattttacggatcagcaataaggttccttctcctagtttccacgtccatatatatctatgctgcgtcgtccttttcgtgacatcaccaaaacacatacaaaa

SEQ ID NO: 45 - DNA, 2472 bp, Artificial Sequence
  Synthetic construct
aaaattaacagatagtttgccggtgataattctcttaacctcccacactcctttgacataacgatttatgtaacgaaactgaaatttgaccagatattgttgtaaatagaaaatctggcttgtaggtggaaactagtaacggccgccagtgtgctggaattcggctccactgtcctccactacaaacacacccaatctgcttcttctagtcaaggttgctacaccggtaaattataaatcatcatttcattagcagggctgggccctttttatagagtcttatacactagcggaccctgccggtagaccaacccgcaggcgcgtcagtttgctccttccatcaatgcgtcgtagaaacgacttactccttcttgagcagctccttgaccttgttggcaacaaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgactcaggcgacgacggaattcgacagcaactactcctttcaccaaccatgtgcattttagctcgaataacattcacaggcttggtgatctacatccatggtgtctggccgattaccgtggtgttttggcagtaacgagaatattgagtggactcttcccatcaccaataaagactcatactacaatcacgagcgcttcagctgccactatagtgttggtgacacaatacccctcgatgctgggcattactgtagcaagagatattatttcatggcgcatttttccagtctacctgactttttagtgtgatttcttctccacattttatgctcagtgtgaaaagttggagtgcacacttaattatcgccggttttcggaaagtactatgtgctcaaggttgcaccccacgttacgtatgcagcacattgagcagcctttggaccgtggagataacggtgtggagatagcaacgggtagtcttcgtaataagcaatgcagccgaattctgcagatatccatcacactggcggccgctcgagcatgcatctagatggcctccttggccgggtttcaattcaattcatcattttttttttattcttttttttgatttcggtttctttgaaatttttttgattcggtaatctccgaacagaaggaagaacgaaggaaggagcacagacttagattggtatatatacgca

SEQ ID NO: 46 - DNA, 6989 bp, Artificial Sequence
  Synthetic construct
ctagatggcctccttggccgggtttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttttataatgacgaaaaaaaaaaaattggaaagaaaaccccccccccgcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaattcccccttacacggaggcatcaagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcaggtgggccattctcatgaagaatatcttgaatttattgtcatattactagttggtgtggaagtccatatatcggtgatcaatatagtggttgacatgctggctagtcaacattgagccttttgatcatgcaaatatattacggtattttacaatcaaatatcaaacttaactattgactttataacttatttaggtggtaacattcttataaaaaagaaaaaaattactgcaaaacagtactagcttttaacttgtatcctaggttatctatgctgtctcaccatagagaatattacctatttcagaatgtatgtccatgattcgccgggtaaatacatataatacacaaatctggcttaataaagtctataatatatctcataaagaagtgctaaattggctagtgctatatatttttaagaaaatttcttttgactaagtccatatcgactttgtaaaagttcactttagcatacatatattacacgagccagaaattgtaacttttgcctaaaatcacaaattgcaaaatttaattgcttgcaaaaggtcacatgcttataatcaacttttttaaaaatttaaaatacttttttattttttatttttaaacataaatgaaataatttatttattgtttatgattaccgaaacataaaacctgctcaagaaaaagaaactgttttgtccttggaaaaaaagcactacctaggagcggccaaaatgccgaggctttcatagcttaaactctttacagaaaataggcattatagatcagttcgagttttcttattcttccttccggttttatcgtcacagttttacagtaaataagtatcacctcttagagttaactatgagataagcaagtatcatctcatttcatttacctgaagtcgagtaaacagaaaatccaattgttgatgaacctcaatgacttagaactatctatcggcagatcatataaagaggatttaggtacctagaggactgtacctggagtatatatatatatatatatatattatctcaactatagtccatagaggtttctttcttgaggccttaaactgctaaagaatgatattggtggaatgcaagcaccaatctctcttctttcgtaactgttcatatacttcaaaccaagaatgtaacgggcattgacccatccaaaaccttcagtagctgcccctttaaagtcagcaccttgattaccgtattctgcttcaacacgatgaggatctgttcctcttgtgacatcatatttttcaaccacaataccattataatcgacaaaagcctttgtcatcatgaaaagccatctataagctagcctattcgttacagttaaataaccataagaacggaggccttcccaagcaagaatttgatggggtgcccaaccaaatggatagtcccattgtctaattggtctcgaaatagaaattgggcctcgagaacgctccgtacatgcagctaaacctccaagcatctctaacttgggtagtgctttctccaccattttctgtgcttgctccttcgtggcaagtccagcccataatgcccagaatgtagttgcggattcgtatgacgttctgtgcttgatttttgtgttgtagtcaaagaaaaaccccgactcgtcatcccacatatatttggtaattgatgaggcaacgctaattatcaacatatagattgttatctatctgcatgaacacgaaatctttacttgacgacttgaggctgatggtgtttatgcaaagaaaccactgtgtttaatatgtgtcactgtttgatattactgtcagcgtagaagataatagtaaaagcggttaataagtgtatttgagataagtgtgataaagtttttacagcgaaaagacgataaatacaagaaaatgattacgaggatacggagagaggtatgtacatgtgtatttatatactaagctgccggcggttgtttgcaagaccgagaaaaggctagcaagaatcgggtcattgtagcgtatgcgcctgtgaacattctcttcaacaagtttgattccattgcggtgaaatggtaaaagtcaaccccctgcgatgtatattttcctgtacaatcaatcaaaaagccaaatgatttagcattatctttacatcttgttattttacagattttatgtttagatcttttatgcttgcttttcaaaaggcctgcaggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggtttccgcgcacatttccccgaaaagtgccacctgacgtctaagaaaccattattatcatgacattaacctataaaaataggcgtatcacgaggccctttcgtcttggccacctaggccggccttcccggaagtatatactaattcattccttgaatatttatgaaaagcaacatgtgtatttcttgtgtgtgcggcaaacgtagcaattgcaactgcataaacgatgattgtaaaagtatcacactttgctcagacaggttagattcacctggtacgagggcagtgtcttaaaggttccatctacctcggcccttgtttcttgaagagtggtcaatatgtgttttatacagctgaaatttcccctgtatgttgagatcgtgtatattggtcataatctgggctctttagtcgatcccagttttctcgggcaagtttttttctccacaaagtaccgctggaaaactctatgtgacttgttgacagattacttgggttatctgcgggatatgtcttggataggcaaccgggcatatatcaccgggcggactgttggttctgtac

SEQ ID NO: 47 - DNA, 1170 bp, Artificial Sequence
  Promoter
tcgggcaagtttttttctccacaaagtaccgctggaaaactctatgtgacttgttgacagattacttgggttatctgcgggatatgtcttggataggcaaccgggcatatatcaccgggcggactgttggttctgtacgtacatacagcactttgagctcatgtctcacacgcaaccatggtgcgtggaggctttggcatcctttctacttgtagtggctatagtacttgcagtccaagcaaacatgagtatgtgcttgtatgtactgaaacccgtctacggtaatattttagagtgtggaactatgggatgagtgctcattcgatactatgttgtcacccgatttgccgtttgcgaggtaagacacattcggtggttcaggcggctacttgtatgtagcatccacgttcatgttttgtggatcagattaatggtatggatatgcacggggcgtttccccggtaacgtgtaggcagtccagtgcaacccagacagctgagctctctatagccgtgcgtgtgcggtcatatcacgctacacttagctacagaataaagctcggtagcgccaacagcgttgacaaatagctcaagggcgtggagcacagggtttaggaggttttaatgggcgagaaggcgcgtagatgtagtcttcctcggtcccatcggtaatcacgtgtgtgccgatttgcaagacgaaaagccacgagaataaaccgggagaggggatggaagtccccgaacagcaaccagcccttgccctcgtggacataacctttcacttgccagaactctaagcgtcaccacggtatacaagcgcacgtagaagattgtggaagtcgtgttggagactgttgatttgggcggtggaggggggtatttgagagcaagtttgagatttgtgccattgagggggaggttattgtggccatgcagtcggatttgccgtcacgggaccgcaacatgcttttcattgcagtccttcaactatccatctcacctcccccaatggcttttaactttcgaatgacgaaagcacccccctttgtacagatgactatttgggaccaatccaatagcgcaattgggtttgcatcatgtataaaaggagcaatcccccactagttataaagtcacaagtatctcagtatacccgtctaaccacacattt

SEQ ID NO: 48 - DNA, 2276 bp, Artificial Sequence
  Hygromycin resistance gene
aaattaacagatagtttgccggtgataattctcttaacctcccacactcctttgacataacgatttatgtaacgaaactgaaatttgaccagatattgttgtaaatagaaaatctggcttgtaggtggcaaactagtaacggccgccagtgtgctggaattgaatatttaccgttcgtataatgtatgctatacgaagttataccggtctcgtagtgttcacgttcagttcacggtgagcttaaaactatcttcaagaagagatttgagacctgatttatacttgcagcaatgtttacttcttatcgcgatacacgaatgtgatacggatcaaagtaagcaggactacgataagataacgaatgcggtgcagtccatgtcgattaggtatagatacatttattttgtgttatgttacattttggggggatactgtcctacttgtagtacctacttgtagtggcgcgtctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatgggtacctgagaacatttttgtgtctaggtgtttgtgtttggactgcgatcagtgaagaaaagaagaggaaaaattgtgcaagaaattttgctttcaagacttggctgatgcagcagggtaactctgggacacagacctatgtttgtggttaaactcaatgcacgtggtacgtgcgtggagcgcttacccatccaagggtgtggacatggaaccgacggtccgtggagttgtgtaatgtcattttggcgactcttgaagcaaggctataaaaaaattgtgtggcttgagtcttatcgagctcggtcactacaagagttaatcttcctgtctcaggcagacaggtcaggcagggttacttttgggtgtgctgtaactcactgtatggccgttagtgcgcatagacgttgtacatactggaccgaattgtagcgtgctcaatagggccaataaagctattgtagggatccataacttcgtataatgtatgctatacgaacggtacccgggcaattctgcagatatccatcacactggcggccgctcgagcatgcatctagatggcctccttggccgggtttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgca

SEQ ID NO: 49 - DNA, 865 bp, Artificial Sequence
  Promoter
atgctcacttttgttgtcctgatgatctcccgttatttcgccgctcctctggaaaccatccgcccgcaaatcccctctgcccatcttgacaatgcacaatgcatcattctcagcctgcatgaatgcgaaagatggcaatattggtggaggaggcgacggcggtaaacaatggagatagagaccacaaaagagacctggagacccaaaatggactcacgacaactcccccactcccccactccccatctccccctgggcatcagttgcccatcggtatctcaactgtcgcactagttagcgcaaccatcacatactttagacgccaaacaatgggacaactcatcgcgccgaactatgggcagattttaactcgcacaacattaccccaactctaaaaggtaacctcgaccggaaaacgggaagacaggatcagcaaccgtgatcgacagaatcttcagggcactacagttgatagacataggttatgttggtaggtctagacgggcctcggggaattgaccccaccagttgcaagtcacgtgcccctgatacagctagtttagcacatctgcccactacgtctggacgcaccatggtggtgccagtcgcgtgaactcaaacacccactagcctcgggaaggattcagttaaatccgcaccttatttccaacacaaagaagcggttggcggacaaagaacatgtcctttctggggcactgtacattccaggactctgttcaaggtcaaatatacaaaacacagatagagaaacatagacagctgcggccttataaatacctgggcgcacttctctctttttccctcctcatcacacattcgttcaccactaagtcactcgttcaaa

SEQ ID NO: 50 - DNA, 1422 bp, Artificial Sequence
  Promoter
atttcttgtgtgtgcggcaaacgtagcaattgcaactgcataaacgatgattgtaaaagtatcacactttgctcagacaggttagattcacctggtacgagggcagtgtcttaaaggttccatctacctcggcccttgtttcttgaagagtggtcaatatgtgttttatacagctgaaatttcccctgtatgttgagatcgtgtatattggtcataatctgggctctttagtcgatcccagttttctcgggcaagtttttttctccacaaagtaccgctggaaaactctatgtgacttgttgacagattacttgggttatctgcgggatatgtcttggataggcaaccgggcatatatcaccgggcggactgttggttctgtacgtacatacagcactttgagctcatgtctcacacgcaaccatggtgcgtggaggctttggcatcctttctacttgtagtggctatagtacttgcagtccaagcaaacatgagtatgtgcttgtatgtactgaaacccgtctacggtaatattttagagtgtggaactatgggatgagtgctcattcgatactatgttgtcacccgatttgccgtttgcgaggtaagacacattcggtggttcaggcggctacttgtatgtagcatccacgttcatgttttgtggatcagattaatggtatggatatgcacggggcgtttccccggtaacgtgtaggcagtccagtgcaacccagacagctgagctctctatagccgtgcgtgtgcggtcatatcacgctacacttagctacagaataaagctcggtagcgccaacagcgttgacaaatagctcaagggcgtggagcacagggtttaggaggttttaatgggcgagaaggcgcgtagatgtagtcttcctcggtcccatcggtaatcacgtgtgtgccgatttgcaagacgaaaagccacgagaataaaccgggagaggggatggaagtccccgaacagcaaccagcccttgccctcgtggacataacctttcacttgccagaactctaagcgtcaccacggtatacaagcgcacgtagaagattgtggaagtcgtgttggagactgttgatttgggcggtggaggggggtatttgagagcaagtttgagatttgtgccattgagggggaggttattgtggccatgcagtcggatttgccgtcacgggaccgcaacatgcttttcattgcagtccttcaactatccatctcacctcccccaatggcttttaactttcgaatgacgaaagcacccccctttgtacagatgactatttgggaccaatccaatagcgcaattgggtttgcatcatgtataaaaggagcaatcccccactagttataaagtcacaagtatctcagtatacccgtctaaccacacatttatcacc

SEQ ID NO: 51 - DNA, 995 bp, Artificial Sequence
  Promoter
ctgtacctgctgtggaccacgcacggcggaacgtaccgtacaaatattttcttgctcacatgactctctctcggccgcgcacgccggtggcaaattgctcttgcattggctctgtctctagacgtccaaaccgtccaaagtggcagggtgacgtgatgcgacgcacgaaggagatggcccggtggcgaggaaccggacacggcgagccggcgggaaaaaaggcggaaaacgaaaagcgaagggcacaatctgacggtgcggctgccaccaacccaaggaggctattttgggtcgctttccatttcacattcgccctcaatggccactttgcggtggtgaacatggtttctgaaacaaccccccagaattagagtatattgatgtgtttaagattgggttgctatttggccattgtgggggagggtagcgacgtggaggacattccagggcgaattgagcctagaaagtggtaccattccaaccgtctcagtcgtccgaattgatcgctataactatcacctctctcacatgtctacttccccaaccaacatccccaacctcccccacactaaagttcacgccaataatgtaggcactctttctgggtgtgggacagcagagcaatacggaggggagattacacaacgagccacaattggggagatggtagccatctcactcgacccgtcgacttttggcaacgctcaattacccaccaaatttgggctggagttgaggggaccgtgttccagcgctgtaggaccagcaacacacacggtatcaacagcaaccaacgcccccgctaatgcacccagtactgcgcaggtgtgggccaggtgcgttccagatgcgagttggcgaaccctaagccgacagtgtactttttgggacgggcagtagcaatcgtgggcggagaccccggtgtatataaaggggtggagaggacggattattagcaccaacacacacacttatactacatgctagccacaaaa

SEQ ID NO: 52 - DNA, 1004 bp, Artificial Sequence
  Promoter
gtcagaaggggcagctctaaacgaagaactgcggtcaggtgacacaactttttccatctcagggtgtgtcgcgtgtgcttcatccaaactttagttggggttcgggttcgcgcgagatgatcacgtgccctgatttggtgtcgtcccccgtcgcgctgcgcacgtgatttatttatttccggtggctgctgtctacgcggggccttctctgcccttctgtttcaaccttcgggcggttctcgtaaccagcagtagcaatccatttcgaaactcaaagagctaaaaacgttaaacctcagcagtcgctcgacgaatgggctgcggttgggaagcccacgaggcctatagccagagcctcgagttgacaggagcccagacgccttttccaacggcaacttttatataaaatggcaatgtattcatgcaattgcggccgtgtcaggttggagacactggaccacactctccattgcttcctgaggagatggatcattgctagtgcatctacgcgcagcaatcccgcaagctcgacaaccgtagatgggctttggtgggccaatcaattacgcaacccgcacgttaaattgtatgaggaaggaaggccacggtacaaagtgggtggtcttcacccagtggttgttggtggcgtcatgcagaccatgcattggggatagcacagggttggggtgtcttgtggactcaatgggtgaaaggagatggaaaagggcggtgaaaagtggtagaatcgaaatccctgacgtcaatttataaagtaaaatgcgtttctgccattttgctcccctccttctttcgcaatcgcctccccaaaagttgtcgtggcagtacacatgcttgcatacaatgaagctaatccggcttgctcagtagttgctatatccaggcatggtgtgaaacccctcaaagtatatataggagcggtgagccccagtctggggtcttttctctccatctcaaaactactttctcacatgctagccacaaaa

SEQ ID NO: 53 - DNA, 880 bp, Artificial Sequence; identical to SEQ ID NO: 41
  Promoter

SEQ ID NO: 54 - DNA, 1000 bp, Artificial Sequence
  Promoter
caattcatgtatcgtgtcaattcatgtatcgtgtcaattcatgtatcgtgtcaatacttatatctcaagtggttgcatcgcaaacagccatcgcatactccactctactctcactgagttcactcttacccggctccaccttctagaagccaccaccgatccaccgacgatgatcagtccaccacttgctctgaatgtgcgttggagctgcaccatgattgatgacgtcaccgccattcagatagggcaaaagacgagcgccaatcgcaacaatgggcgagtgtcgacgactcccccgctctctgcggtttcagcgactccaaccgtcgccaaaagaccgtcattttcgtctaaagcgcagcccagcccatctcttctaaaagattccagaaagatagggttcaccaactacgcaccaatatgtacagtatcgtagctactccggcttggctgatctgagagatagagatggctccgaaacgcggaaaacggcggggtcggaccgatcacgtgacacgtactcatccgtcgcgccccgagcgccatttcaacaccaaatactcccggtcacgtgccaccccgcccgctctacccacgagatgtttctacactatacactgccacgccgtcatacctgcagctaggttaacattcgattaattagtggagtcaccagtgtacaggactatggcggaaaccgggttacacaaaccggcccggaatagcagcattataccgctggacgagatcaccgtcaataaattgcgtcgttactcgggacaaccattgctcctccggctacacctgctcaaaggacttgttccacactcttccccagctctcccacgcaaacaaagagagcaaccttaagtggacagctcatgagcactcccctcgtttgctgcccacgctcgattatataaagaccagcggatccccttctatttggacttgcatcaaccaaccacaacccacaccaagcacacaaagcacaagaaca

SEQ ID NO: 55 - DNA, 300 bp, Artificial Sequence
  Terminator
atgtggtgattgctgttgtgcaagcctttgctcgttttctgctgtatgtaatttaaagaacgattgtatgaatcgaagtcaaggtgagtgtagtttgagaagtgtaaccccagtgtcatagctgtgtactccattcattgaagggtgtagtcgtgttttattgcatgagcgcctattactcgtataagtaactgttttgtaacacttcatgaacggagatggtatgaacagaagtaataatatcctggaagtcagctgtgcccagaggtgtgtgtgggtgtggcatactttgggacaaca

SEQ ID NO: 56 - DNA, 200 bp, Artificial Sequence
  Terminator
ctatccgaagatcaagagcgaagcaagttgtaagtccaggacatgtttcccgcccacgcgagtgatttataacacctctcttttttgacacccgctcgccttgaaattcatgtcacataaattatagtcaacgacgtttgaataacttgtcttgtagttcgatgatgatcatatgattacattaatagtaattactgtat

SEQ ID NO: 57 - DNA, 298 bp, Artificial Sequence
  Terminator
gcattatagatgaatcatttaaaaagagatgacttgtagtaccatgcttgtagggtgtagtataatgcgaggctcgtatttctggacgcgctcgattatggtttagacagcatgatcgtgtggcacgggtacggagcagcgggagcagtggcgaatagctgtttatgggattctcgtttactgcaggaggtttatatggggtgttggatgtgtcttgtttcgtcttcaaatggagcgttttgagtgccatgatgagtagtctatgcttagcctggactgggagctacaagtagtggtg

SEQ ID NO: 58 - DNA, 200 bp, Artificial Sequence
  Terminator
gctatttacagcatgtgtaatgaggaatataacgttgattgaattgtttgtgaaaaatgtagaaaatttcagtgaagttgtgttttctatatagtaagcacttttggtacaagtatctgcacatccctgcatgttacaagcctgatcatgcagggcaatattctgactataaatatacctcgatattttagcaagctata

SEQ ID NO: 59 - DNA, 200 bp, Artificial Sequence
  Terminator
acttcgagctaatccagtagcttacgttacccaggggcaggtcaactggctagccacgagtctgtcccaggtcgcaatttagtgtaataaacaatatatatattgagtctaaagggaattgtagctattgtgattgtgtgattttcgtcttgctggttcttattgtgtcccattcgtttcatcctgatgaggacccctgg

SEQ ID NO: 60 - DNA, 127 bp, Artificial Sequence
  Terminator
aattaacagatagtttgccggtgataattctcttaacctcccacactcctttgacataacgatttatgtaacgaaactgaaatttgaccagatattgttgtaaatagaaaatctggcttgtaggtgg

SEQ ID NO: 61 - protein, 799 aa, Artificial Sequence
  Q9FXV9, Lactuca sativa (Garden Lettuce)
MKTMISSPIPAFHPRFSPAAGSRRLSPILPSSGSVVLTGSKTQCKAVSKSPTQEYFDVLQKNGLPFINWQNDVVEDELDKEKKILYPNDEIKGFVERIKVMLGSMDEGEITVSAYDTAWVALVQDIDGNGRPEFPSSLEWIVKNQLSDGSWGDHLIFSAHDRIINTLACVIALTSWNVHPGKCQKGLKFLNDNISKLEEENPEHMPIGFEVAFPSLIDIARKLDIQVPEDSPALKEIYARRNLKLTKIPKSLMHKVPTTLLHSLEGMPDLEWEKLLKLQCKDGSFLFSPSSTAFALMQTKDQKCLQYLTDAVTKFNGGVPNVYPVDLFEHIWVVDRLQRLGISRYFDSEIKDCVDYIYRYWTKDGICWAKNSNVQDIDDTAMGFRVLRMHGYKVTTDVFRQFEKDGKFVCFPGQTTQAVTGMFNLFRASQVLFPDEKILEDAKKFSYNYLKEKQSTNELLDKWIIAKDLPGEVEYALDVPWYASLPRLETRFYLEQYGGEDDVWIGKTLYRMGNVSNNTYLEMAKLDYNNCLAIHHLEWNTMQQWYVDFGMERFGTSDITSLLVSYYLAAASVFEPERSKERIAWAKTTTLVDTISSFFHSLKISNEHRREFVEEFRNISNSIHHAKYGKPWHGLMVALKGTLHEIALDVLMTHRRDIHPQLHHAWEMWLMRWQQGVDATEGQAELIVQTINMTAGRWVSNELLAHPQYRLLSSVINNICHEIYHNRTCMEVNSTTISTSIDSKMQELVQLVLSDSLDDLDQDLKQTFLTVAKTFYYKAYCDPETINVHISKVMFETII

SEQ ID NO: 62 - protein, 757 aa, Artificial Sequence
  Q9FXV9, Lactuca sativa (Garden Lettuce)
MCKAVSKSPTQEYFDVLQKNGLPFINWQNDVVEDELDKEKKILYPNDEIKGFVERIKVMLGSMDEGEITVSAYDTAWVALVQDIDGNGRPEFPSSLEWIVKNQLSDGSWGDHLIFSAHDRIINTLACVIALTSWNVHPGKCQKGLKFLNDNISKLEEENPEHMPIGFEVAFPSLIDIARKLDIQVPEDSPALKEIYARRNLKLTKIPKSLMHKVPTTLLHSLEGMPDLEWEKLLKLQCKDGSFLFSPSSTAFALMQTKDQKCLQYLTDAVTKFNGGVPNVYPVDLFEHIWVVDRLQRLGISRYFDSEIKDCVDYIYRYWTKDGICWAKNSNVQDIDDTAMGFRVLRMHGYKVTTDVFRQFEKDGKFVCFPGQTTQAVTGMFNLFRASQVLFPDEKILEDAKKFSYNYLKEKQSTNELLDKWIIAKDLPGEVEYALDVPWYASLPRLETRFYLEQYGGEDDVWIGKTLYRMGNVSNNTYLEMAKLDYNNCLAIHHLEWNTMQQWYVDFGMERFGTSDITSLLVSYYLAAASVFEPERSKERIAWAKTTTLVDTISSFFHSLKISNEHRREFVEEFRNISNSIHHAKYGKPWHGLMVALKGTLHEIALDVLMTHRRDIHPQLHHAWEMWLMRWQQGVDATEGQAELIVQTINMTAGRWVSNELLAHPQYRLLSSVINNICHEIYHNRTCMEVNSTTISTSIDSKMQELVQLVLSDSLDDLDQDLKQTFLTVAKTFYYKAYCDPETINVHISKVMFETII

SEQ ID NO: 63 - protein, 761 aa, Artificial Sequence
  D2X8G0, Picea glauca
MKMSKSVEVQHCAVQFLSSTTDQIEIRERNLQISTEAMKMKSWIETVKYILQSMEDGEITISAYDTAWIALVPALNGSSEPQFPSSLQWLINNQLQDGSWGDPLMFLIRDRIINTLACVLALKTWNIHSLGVNKGLSFLQTYIPKMNDEHDAHTPVGFEIVFPALMEDAKIMELDLPYDAEFLQKIYDERDLKMKRIPMKVLHEFPSTLLHSLEGLRDKVNWEELLKLQSKNGSFLFSPASTACALAQTSDTNCLRYLNEITKKYDGGAPNVYPVDLFERLWTVDRIERLGIARYFESEITDSLEYVYRYWTNQGIGWARDSPVKDVDDTSMAFRLLRSHGFDVTAEAFNHFKQDDQFFCFFGQTKQTVTGMYNLYRASQFSFPGESILEEARVFTKNFLEEKRAEKQLRDKWIIAKGLKEEVEYALKFPWYASQPRIDTRMYINQYRVDDVWIGKALYRMPIVNNKTYIELAKADFNICQSIHRTELHGIIRWYRESGLDELGLRQDQIVKSYFLAAIAIYEPDMASARLAWAKSAVLMAAIRIFFSGENCFAHHRRQFLDAFTRWDGRAMRDSPNSAKRLFSCLFRMVNLFSVDGVVAQGRDISGDLRHRWEHWLASEAEDLTDAQDHEKLGTEAEIVVLTAAFLGRETISPDLISHPDFSSIMKVTNTVCSLLRRIATYKEEGCDSPSGTEEDDRLKRRAEEGMGHLVRAVYRHQYSPVPSGVKRLCLVVGKSFYYAAHCNNEEVGNHVETVLFQPVY

SEQ ID NO: 64 - protein, 516 aa, Artificial Sequence
  Q45221, Bradyrhizobium japonicum
MNALSEHILSELRRLLSEMSDGGSVGPSVYDTAQALRFHGNVTGRQDAYAWLIAQQQADGGWGSADFPLFRHAPTWAALLALQRADPLPGAADAVQTATRFLQRQPDPYAHAVPEDAPIGAELILPQFCGEAASLLGGVAFPRHPALLPLRQACLVKLGAVAMLPSGHPLLHSWEAWGTSPTTACPDDDGSIGISPAATAAWRAQAVTRGSTPQVGRADAYLQMASRATRSGIEGVFPNVWPINVFEPCWSLYTLHLAGLFAHPALAEAVRVIVAQLDARLGVHGLGPALHFAADADDTAVALCVLHLAGRDPAVDALRHFEIGELFVTFPGERNASVSTNIHALHALRLLGKPAAGASAYVEANRNPHGLWDNEKWHVSWLYPTAHAVAALAQGKPQWRDERALAALLQAQRDDGGWGAGRGSTFEETAYALFALHVMDGSEEATGRRRIAQVVARALEWMLARHAAHGLPQTPLWIGKELYCPTRVVRVAELAGLWLALRWGRRVLAEGAGAAP

SEQ ID NO: 65 - protein, 946 aa, Artificial Sequence
  O13284, Phaeosphaeria sp
MFAKFDMLEEEARALVRKVGNAVDPIYGFSTTSCQIYDTAWAAMISKEEHGDKVWLFPESFKYLLEKQGEDGSWERHPRSKTVGVLNTAAACLALLRHVKNPLQLQDIAAQDIELRIQRGLRSLEEQLIAWDDVLDTNHIGVEMIVPALLDYLQAEDENVDFEFESHSLLMQMYKEKMARFSPESLYRARPSSALHNLEALIGKLDFDKVGHHLYNGSMMASPSSTAAFLMHASPWSHEAEAYLRHVFEAGTGKGSGGFPGTYPTTYFELNWVLSTLMKSGFTLSDLECDELSSIANTIAEGFECDHGVIGFAPRAVDVDDTAKGLLTLTLLGMDEGVSPAPMIAMFEAKDHFLTFLGERDPSFTSNCHVLLSLLHRTDLLQYLPQIRKTTTFLCEAWWACDGQIKDKWHLSHLYPTMLMVQAFAEILLKSAEGEPLHDAFDAATLSRVSICVFQACLRTLLAQSQDGSWHGQPEASCYAVLTLAESGRLVLLQALQPQIAAAMEKAADVMQAGRWSCSDHDCDWTSKTAYRVDLVAAAYRLAAMKASSNLTFTVDDNVSKRSNGFQQLVGRTDLFSGVPAWELQASFLESALFVPLLRNHRLDVFDRDDIKVSKDHYLDMIPFTWVGCNNRSRTYVSTSFLFDMMIISMLGYQIDEFFEAEAAPAFAQCIGQLHQVVDKVVDEVIDEVVDKVVGKVVGKVVGKVVDERVDSPTHEAIAICNIEASLRRFVDHVLHHQHVLHASQQEQDILWRELRAFLHAHVVQMADNSTLAPPGRTFFDWVRTTAADHVACAYSFAFACCITSATIGQGQSMFATVNELYLVQAAARHMTTMCRMCNDIGSVDRDFIEANINSVHFPEFSTLSLVADKKKALARLAAYEKSCLTHTLDQFENEVLQSPRVSSAASGDFRTRKVAVVRFFADVTDFYDQLYILRDLSSSLKHVGT

SEQ ID NO: 66 - protein, 952 aa, Artificial Sequence
  Q9UVY5, Gibberella fujikuroi
MPGKIENGTPKDLKTGNDFVSAAKSLLDRAFKSHHSYYGLCSTSCQVYDTAWVAMIPKTRDNVKQWLFPECFHYLLKTQAADGSWGSLPTTQTAGILDTASAVLALLCHAQEPLQILDVSPDEMGLRIEHGVTSLKRQLAVWNDVEDTNHIGVEFIIPALLSMLEKELDVPSFEFPCRSILERMHGEKLGHFDLEQVYGKPSSLLHSLEAFLGKLDFDRLSHHLYHGSMMASPSSTAAYLIGATKWDDEAEDYLRHVMRNGAGHGNGGISGTFPTTHFECSWIIATLLKVGFTLKQIDGDGLRGLSTILLEALRDENGVIGFAPRTADVDDTAKALLALSLVNQPVSPDIMIKVFEGKDHFTTFGSERDPSLTSNLHVLLSLLKQSNLSQYHPQILKTTLFTCRWWWGSDHCVKDKWNLSHLYPTMLLVEAFTEVLHLIDGGELSSLFDESFKCKIGLSIFQAVLRIILTQDNDGSWRGYREQTCYAILALVQARHVCFFTHMVDRLQSCVDRGFSWLKSCSFHSQDLTWTSKTAYEVGFVAEAYKLAALQSASLEVPAATIGHSVTSAVPSSDLEKYMRLVRKTALFSPLDEWGLMASIIESSFFVPLLQAQRVEIYPRDNIKVDEDKYLSIIPFTWVGCNNRSRTFASNRWLYDMMYLSLLGYQTDEYMEAVAGPVFGDVSLLHQTIDKVIDNTMGNLARANGTVHSGNGHQHESPNIGQVEDTLTRFTNSVLNHKDVLNSSSSDQDTLRREFRTFMHAHITQIEDNSRFSKQASSDAFSSPEQSYFQWVNSTGGSHVACAYSFAFSNCLMSANLLQGKDAFPSGTQKYLISSVMRHATNMCRMYNDFGSIARDNAERNVNSIHFPEFTLCNGTSQNLDERKERLLKIATYEQGYLDRALEALERQSRDDAGDRAGSKDMRKLKIVKLFCDVTDLYDQLYVIKDLSSSMK

SEQ ID NO: 67 - protein, 787 aa, Artificial Sequence
  O22667, Stevia rebaudiana
MKTGFISPATVFHHRISPATTFRHHLSPATTNSTGIVALRDINFRCKAVSKEYSDLLQKDEASFTKWDDDKVKDHLDTNKNLYPNDEIKEFVESVKAMFGSMNDGEINVSAYDTAWVALVQDVDGSGSPQFPSSLEWIANNQLSDGSWGDHLLFSAHDRIINTLACVIALTSWNVHPSKCEKGLNFLRENICKLEDENAEHMPIGFEVTFPSLIDIAKKLNIEVPEDTPALKEIYARRDIKLTKIPMEVLHKVPTTLLHSLEGMPDLEWEKLLKLQCKDGSFLFSPSSTAFALMQTKDEKCLQYLTNIVTKFNGGVPNVYPVDLFEHIWVVDRLQRLGIARYFKSEIKDCVEYINKYWTKNGICWARNTHVQDIDDTAMGFRVLRAHGYDVTPDVFRQFEKDGKFVCFAGQSTQAVTGMFNVYRASQMLFPGERILEDAKKFSYNYLKEKQSTNELLDKWIIAKDLPGEVGYALDIPWYASLPRLETRYYLEQYGGEDDVWIGKTLYRMGYVSNNTYLEMAKLDYNNYVAVLQLEWYTIQQWYVDIGIEKFESDNIKSVLVSYYLAAASIFEPERSKERIAWAKTTILVDKITSIFDSSQSSKEDITAFIDKFRNKSSSKKHSINGEPWHEVMVALKKTLHGFALDALMTHSQDIHPQLHQAWEMWLTKLQDGVDVTAELMVQMINMTAGRWVSKELLTHPQYQRLSTVTNSVCHDITKLHNFKENSTTVDSKVQELVQLVFSDTPDDLDQDMKQTFLTVMKTFYYKAWCDPNTINDHISKVFEIVI

SEQ ID NO: 68 - protein, 743 aa, Artificial Sequence
  O22667, Stevia rebaudiana
MCKAVSKEYSDLLQKDEASFTKWDDDKVKDHLDTNKNLYPNDEIKEFVESVKAMFGSMNDGEINVSAYDTAWVALVQDVDGSGSPQFPSSLEWIANNQLSDGSWGDHLLFSAHDRIINTLACVIALTSWNVHPSKCEKGLNFLRENICKLEDENAEHMPIGFEVTFPSLIDIAKKLNIEVPEDTPALKEIYARRDIKLTKIPMEVLHKVPTTLLHSLEGMPDLEWEKLLKLQCKDGSFLFSPSSTAFALMQTKDEKCLQYLTNIVTKFNGGVPNVYPVDLFEHIWVVDRLQRLGIARYFKSEIKDCVEYINKYWTKNGICWARNTHVQDIDDTAMGFRVLRAHGYDVTPDVFRQFEKDGKFVCFAGQSTQAVTGMFNVYRASQMLFPGERILEDAKKFSYNYLKEKQSTNELLDKWIIAKDLPGEVGYALDIPWYASLPRLETRYYLEQYGGEDDVWIGKTLYRMGYVSNNTYLEMAKLDYNNYVAVLQLEWYTIQQWYVDIGIEKFESDNIKSVLVSYYLAAASIFEPERSKERIAWAKTTILVDKITSIFDSSQSSKEDITAFIDKFRNKSSSKKHSINGEPWHEVMVALKKTLHGFALDALMTHSQDIHPQLHQAWEMWLTKLQDGVDVTAELMVQMINMTAGRWVSKELLTHPQYQRLSTVTNSVCHDITKLHNFKENSTTVDSKVQELVQLVFSDTPDDLDQDMKQTFLTVMKTFYYKAWCDPNTINDHISKVFEIVI

SEQ ID NO: 69 - DNA, 2397 bp, Artificial Sequence
  Q9FXV9, Lactuca sativa (Garden Lettuce)
atgaaaaccatgatttcttctccaatcccagctttccacccaagattttctccagctgctggttccagaagattatctccaatcttgccatcttccggttctgttgtcttgactggttccaagactcaatgtaaggccgtttctaaatctccaactcaagaatactttgatgttttgcaaaagaacggtttgccattcatcaactggcaaaacgatgtcgttgaagatgaattggacaaggaaaagaagatcttgtacccaaacgacgaaatcaagggtttcgttgaaagaatcaaagttatgttaggttccatggacgaaggtgaaatcactgtctctgcttatgacaccgcttgggttgctttggtccaagatatcgatggtaacggtagaccagaatttccttcttctctagaatggatcgtcaagaaccaattatccgatggttcctggggtgaccatttgatcttctctgctcacgacagaatcattaacactttggcttgtgtcattgctttgacttcctggaacgttcatccaggtaagtgtcaaaagggtttaaagttcttgaacgacaacatctccaagttggaagaagaaaacccagaacacatgccaatcggttttgaagttgctttcccatctttgattgatattgccagaaagttggatatccaagttccagaagattccccagctttgaaggaaatttacgccagaagaaacttgaaattgaccaagattccaaagtctttgatgcacaaggttccaactactttgttgcattctttggaaggtatgccagacttggaatgggaaaagttgttgaagctacaatgtaaggatggttctttcttgttctctccatcttccactgctttcgctttgatgcaaaccaaggaccaaaagtgtttgcaatacttgactgacgctgtcaccaagttcaacggtggtgttccaaacgtctacccagtcgacttgttcgaacacatctgggttgttgacagattgcaaagattaggtatctccagatacttcgactctgaaatcaaagactgtgtcgactacatctacagatactggaccaaggatggtatctgttgggctaagaactccaacgttcaagatattgatgacaccgctatgggtttcagagttttgagaatgcacggttacaaggtcactactgatgttttccgtcaattcgaaaaggacggtaaattcgtttgtttcccaggtcaaaccacccaagctgtcaccggtatgttcaacttgtttagagcttctcaagtcttgttcccagacgaaaagattttggaagatgctaagaaattctcttacaactacttgaaggaaaagcaatccaccaacgaattattggacaaatggatcattgccaaggacttgccaggtgaagttgaatacgctttagatgttccatggtacgcttccttgccacgtttggaaaccagattctacttggaacaatacggtggtgaagatgacgtctggatcggtaagactttgtacagaatgggtaatgtctccaacaacacctacttggaaatggccaaattggactacaacaactgtttggccattcatcacttggaatggaacaccatgcaacaatggtacgttgacttcggtatggaaagattcggtacttctgatatcacttctctattagtctcttactacttggctgctgcctccgtctttgaacctgaacgttctaaggaaagaattgcttgggctaagaccaccactttggttgacaccatctcttctttcttccactccttgaagatctctaacgaacaccgtcgtgaattcgttgaagaattcagaaacatctccaactccatccaccacgctaagtacggtaagccatggcacggtttgatggttgctttgaaaggtactttacacgaaattgccttggatgtcttgatgactcacagaagagacattcaccctcaattgcaccatgcttgggaaatgtggttgatgagatggcaacaaggtgtcgatgccactgaaggtcaagctgaattaattgttcaaaccatcaacatgactgctggtagatgggtttccaatgaattattggctcacccacaatacagattattgtcctctgtcatcaacaatatctgtcacgaaatctaccacaacagaacctgtatggaagtcaactctaccaccatttccacttctattgactccaagatgcaagaattggttcaattagtcttgtctgactctttggacgacttggaccaagatttgaagcaaaccttcttgactgttgccaagactttctactacaaggcttactgtgacccagaaaccatcaacgttcacatttctaaggtcatgttcgaaaccattatt

SEQ ID NO: 70 - DNA, 2271 bp, Artificial Sequence
  Q9FXV9, Lactuca sativa (Garden Lettuce)
atgtgtaaggccgtttctaaatctccaactcaagaatactttgatgttttgcaaaagaacggtttgccattcatcaactggcaaaacgatgtcgttgaagatgaattggacaaggaaaagaagatcttgtacccaaacgacgaaatcaagggtttcgttgaaagaatcaaagttatgttaggttccatggacgaaggtgaaatcactgtctctgcttatgacaccgcttgggttgctttggtccaagatatcgatggtaacggtagaccagaatttccttcttctctagaatggatcgtcaagaaccaattatccgatggttcctggggtgaccatttgatcttctctgctcacgacagaatcattaacactttggcttgtgtcattgctttgacttcctggaacgttcatccaggtaagtgtcaaaagggtttaaagttcttgaacgacaacatctccaagttggaagaagaaaacccagaacacatgccaatcggttttgaagttgctttcccatctttgattgatattgccagaaagttggatatccaagttccagaagattccccagctttgaaggaaatttacgccagaagaaacttgaaattgaccaagattccaaagtctttgatgcacaaggttccaactactttgttgcattctttggaaggtatgccagacttggaatgggaaaagttgttgaagctacaatgtaaggatggttctttcttgttctctccatcttccactgctttcgctttgatgcaaaccaaggaccaaaagtgtttgcaatacttgactgacgctgtcaccaagttcaacggtggtgttccaaacgtctacccagtcgacttgttcgaacacatctgggttgttgacagattgcaaagattaggtatctccagatacttcgactctgaaatcaaagactgtgtcgactacatctacagatactggaccaaggatggtatctgttgggctaagaactccaacgttcaagatattgatgacaccgctatgggtttcagagttttgagaatgcacggttacaaggtcactactgatgttttccgtcaattcgaaaaggacggtaaattcgtttgtttcccaggtcaaaccacccaagctgtcaccggtatgttcaacttgtttagagcttctcaagtcttgttcccagacgaaaagattttggaagatgctaagaaattctcttacaactacttgaaggaaaagcaatccaccaacgaattattggacaaatggatcattgccaaggacttgccaggtgaagttgaatacgctttagatgttccatggtacgcttccttgccacgtttggaaaccagattctacttggaacaatacggtggtgaagatgacgtctggatcggtaagactttgtacagaatgggtaatgtctccaacaacacctacttggaaatggccaaattggactacaacaactgtttggccattcatcacttggaatggaacaccatgcaacaatggtacgttgacttcggtatggaaagattcggtacttctgatatcacttctctattagtctcttactacttggctgctgcctccgtctttgaacctgaacgttctaaggaaagaattgcttgggctaagaccaccactttggttgacaccatctcttctttcttccactccttgaagatctctaacgaacaccgtcgtgaattcgttgaagaattcagaaacatctccaactccatccaccacgctaagtacggtaagccatggcacggtttgatggttgctttgaaaggtactttacacgaaattgccttggatgtcttgatgactcacagaagagacattcaccctcaattgcaccatgcttgggaaatgtggttgatgagatggcaacaaggtgtcgatgccactgaaggtcaagctgaattaattgttcaaaccatcaacatgactgctggtagatgggtttccaatgaattattggctcacccacaatacagattattgtcctctgtcatcaacaatatctgtcacgaaatctaccacaacagaacctgtatggaagtcaactctaccaccatttccacttctattgactccaagatgcaagaattggttcaattagtcttgtctgactctttggacgacttggaccaagatttgaagcaaaccttcttgactgttgccaagactttctactacaaggcttactgtgacccagaaaccatcaacgttcacatttctaaggtcatgttcgaaaccattatt

SEQ ID NO: 71 - DNA, 2283 bp, Artificial Sequence
  D2X8G0, Picea glauca
atgaagatgtccaagtctgttgaagtccaacactgtgctgtccaattcttgtcttccaccaccgatcaaatcgaaatcagagaaagaaacttgcaaatctccactgaagccatgaagatgaaatcctggattgaaaccgtcaaatacattttgcaatccatggaagatggtgaaatcaccatctccgcttacgacactgcttggatcgccttggttccagctttgaacggttcctctgaacctcaattcccatcctctttacaatggttgatcaacaaccaattgcaagacggttcctggggtgacccattgatgttcttgattagagatcgtatcatcaacactttggcttgtgttttggctttgaagacctggaacattcactctttgggtgttaacaagggtctatctttcttgcaaacttacatccctaaaatgaacgatgaacatgatgctcacactccagttggtttcgaaattgtcttcccagctttgatggaagatgccaagatcatggaattggacttgccatacgacgctgaattcttgcaaaagatttacgatgaaagagatttgaagatgaagagaatcccaatgaaggttttgcacgaattcccatctactttattgcactccttggaaggtttgagagacaaggtcaactgggaagaattattgaagttgcaatccaagaacggttctttcttattctctccagcttctactgcttgtgctttggctcaaacttctgacaccaactgtttgagatacttgaatgaaatcaccaagaaatacgacggtggtgctccaaatgtttacccagtcgacttgttcgaaagattatggaccgtcgatcgtattgaaagattaggtattgctagatactttgaatctgaaatcactgactctttggaatacgtttacagatactggactaaccaaggtatcggttgggctagagattctccagttaaggacgtcgatgacacttccatggctttcagactattacgttcccacggtttcgacgttactgctgaagctttcaaccacttcaagcaagatgaccaattcttctgtttctttggtcaaaccaagcaaaccgtcactggtatgtacaacttgtacagagcttctcaattctccttcccaggtgaatctatcttagaagaagctcgtgtcttcaccaagaacttcttggaagaaaagagagctgaaaagcaattgagagacaaatggatcattgctaaaggtttgaaggaagaagtcgaatacgctttgaagttcccatggtatgcctcccaaccaagaattgacaccagaatgtacatcaaccaatacagagttgatgacgtctggatcggtaaggctctatacagaatgccaattgtcaacaacaagacctacatcgaattggccaaggctgacttcaacatttgtcaatctatccacagaactgaattgcacggtatcatcagatggtacagagaatccggtttggacgaattgggtttgagacaagaccaaatcgtcaaatcttacttcttggctgccattgctatctacgaaccagacatggcctctgccagattagcttgggctaagtctgctgtcttgatggctgctatcagaatcttcttttccggtgaaaactgttttgcccaccatagaagacaattcttggatgcctttaccagatgggacggtagagccatgagagattctccaaactccgctaagagattattctcttgtttattcagaatggttaacttgttctctgtcgacggtgttgttgctcaaggtagagacatctccggtgacttgagacacagatgggaacactggttggcctctgaagctgaagacttgaccgatgctcaagaccacgaaaagttgggtactgaagctgaaattgttgttttgactgctgctttcttgggtagagaaaccatttctccagatttgatttctcacccagatttctcttctattatgaaggttaccaacactgtttgttctttattgagaagaattgccacctacaaggaagaaggttgtgactccccatctggtactgaagaagatgacagattgaaacgtcgtgctgaagaaggtatgggtcatttggttcgtgccgtttacagacaccaatactctccagttccatctggtgtcaagagattgtgtttggttgttggtaagtccttttactacgctgctcactgtaacaatgaagaagttggtaaccatgtcgaaaccgtcttgttccaaccagtatac

SEQ ID NO: 72 - DNA, 1548 bp, Artificial Sequence
  Q45221, Bradyrhizobium japonicum
atgaacgctttgtctgaacacatcttatctgaattgagaagattattgtccgaaatgtctgacggtggttccgtcggtccttccgtttacgacaccgcccaagccttgagattccacggtaacgtcactggtagacaagatgcttacgcttggttgattgctcaacaacaagctgacggtggttggggttctgctgatttcccattattcagacatgccccaacctgggctgctctattggctttgcaaagagctgacccattgccaggtgctgctgatgccgtccaaaccgccaccagattcttgcaaagacaaccagacccatacgctcatgccgttccagaagatgctccaatcggtgctgaattgatcttgcctcaattctgtggtgaagctgcttctctattaggtggtgttgccttcccaagacacccagctttgttgccattgagacaagcttgtttggtcaaattgggtgccgttgccatgttgccatctggtcacccattgttgcactcctgggaagcctggggtacttctccaactactgcttgtccagacgatgacggttccatcggtatctctccagctgctactgctgcttggagagcccaagccgttaccagaggttccactccacaagtcggtagagctgatgcttacttgcaaatggcttccagagccaccagatctggtattgaaggtgttttcccaaatgtctggccaatcaacgtctttgaaccatgttggtctttgtacactttgcacttggctggtttgtttgctcatccagctttggctgaagccgtcagagtcattgttgctcaattggatgctagattaggtgtccacggtttaggtccagctttgcacttcgctgctgacgctgatgacaccgccgttgctctatgtgttttgcacttggctggtcgtgacccagctgttgacgctttgagacacttcgaaattggtgaattgttcgtcactttcccaggtgaaagaaacgcttctgtttccaccaacatccacgctttgcacgctttgagattgttgggtaagccagctgctggtgcttctgcttacgttgaagccaacagaaacccacacggtttatgggacaacgaaaagtggcacgtttcctggttatacccaactgctcacgccgttgctgctttggcccaaggtaagcctcaatggagagatgaaagagctttggccgctttgttgcaagctcaaagagatgacggtggttggggtgctggtcgtggttctactttcgaagaaaccgcctacgctttgtttgctttgcatgtcatggacggttctgaagaagctaccggtagaagaagaattgctcaagttgttgccagagctttggaatggatgttggctcgtcacgctgcccacggtttgccacaaactccattatggatcggtaaggaattgtactgtccaaccagagttgtcagagttgctgaattggctggtttatggttggctttgagatggggtcgtcgtgtcttggctgaaggtgctggtgctgcaccc

SEQ ID NO: 73 - DNA, 2838 bp, Artificial Sequence
  O13284, Phaeosphaeria sp
atgtttgctaagtttgatatgttggaagaagaagctagagctttggtcagaaaggtcggtaacgctgttgacccaatctacggtttctctaccacttcctgtcaaatctacgacaccgcttgggctgctatgatctccaaggaagaacacggtgacaaggtctggttgttcccagaatctttcaaatacttgttggaaaagcaaggtgaagatggttcctgggaaagacatccaagatccaagactgtcggtgttttgaacactgctgccgcttgtttggccttgttgagacacgtcaagaaccctttgcaattgcaagacattgctgcccaagacatcgaattgagaatccaaagaggtttgcgttctttggaagaacaattgattgcttgggatgatgtcttggacaccaaccacatcggtgtcgaaatgattgttccagctttgttggactacttgcaagccgaagatgaaaacgttgactttgaattcgaatcccactctctattgatgcaaatgtacaaagaaaagatggccagattctccccagaatccttatacagagctagaccatcttctgccttacataatttggaagctttgatcggtaaattggactttgacaaggttggtcaccacttgtacaacggttccatgatggcttccccatcttccactgctgcctttctaatgcatgcctctccatggtcccacgaagctgaagcttacctacgtcacgttttcgaagctggtactggtaagggttccggtggtttcccaggtacttacccaaccacttacttcgaattgaactgggttttgtccactttgatgaaatctggtttcactttatctgatttggaatgtgatgaattatcttccattgccaacaccattgctgaaggtttcgaatgtgaccacggtgtcatcggttttgctccaagagctgtcgatgtcgacgacaccgctaagggtttgttgactttaactttattaggtatggatgaaggtgtttctccagctccaatgattgctatgttcgaagccaaggaccacttcttgactttcttgggtgaacgtgacccatctttcacttctaactgtcacgttttgttatctttgttgcacagaaccgatttgttgcaatatttgcctcaaatcagaaagaccaccaccttcttgtgtgaagcctggtgggcttgtgacggtcaaatcaaggacaaatggcacttatctcacttgtacccaaccatgttgatggtccaagctttcgctgaaatcttattgaagtctgctgaaggtgaaccattgcacgatgctttcgatgccgctactttgtccagagtctccatttgtgttttccaagcttgtttgagaactctattggcccaatctcaagatggttcttggcacggtcaaccagaagcttcttgttacgctgtcttgactttggctgaatctggtcgtttggttttgttgcaagctttgcaaccacaaatcgctgctgccatggaaaaggccgctgatgttatgcaagctggtagatggtcctgttctgatcatgactgtgactggacctccaagaccgcttacagagttgacttagttgctgctgcttacagattagctgctatgaaagcttcttccaacttgactttcaccgtcgatgacaacgtttccaagagatccaacggtttccaacaattggtcggtagaactgacttgttctctggtgtcccagcctgggaattacaagcttctttcttggaatctgctttgttcgttcctttgttgagaaaccatagattggatgttttcgacagagatgacatcaaggtttctaaggaccactacttggacatgatcccattcacctgggttggttgtaacaacagatctagaacctacgtttctacctctttcttgttcgacatgatgatcatctccatgttgggttaccaaatcgatgaattcttcgaagctgaagctgctccagctttcgctcaatgtattggtcaattgcaccaagtcgtcgacaaggttgttgatgaagtcattgacgaagtcgtcgataaggttgtcggtaaggtcgttggtaaggttgttggtaaggttgtcgacgaacgtgttgactctccaacccacgaagccattgccatctgtaacatcgaagcttctttaagaagattcgtcgatcacgttttgcaccaccaacatgtcttacacgcttctcaacaagaacaagacattttgtggagagaattgagagccttcttgcacgctcacgttgtccaaatggccgacaactccactttggctccaccaggtagaactttcttcgactgggttagaaccactgctgctgaccacgttgcctgtgcttactctttcgctttcgcttgttgtatcacctctgctactatcggtcaaggtcaatctatgttcgctaccgtcaacgaattgtacttggtccaagctgctgctcgtcacatgaccaccatgtgtagaatgtgtaacgacattggttccgtcgacagagatttcatcgaagctaacattaactccgttcacttcccagaattctccactttgtctttggttgctgacaagaagaaagctttggccagattggctgcctacgaaaagtcttgtttgactcacactttggaccaatttgaaaatgaagttttacaatctccacgtgtttcttctgctgcctccggtgatttcagaaccagaaaggttgccgttgttagattctttgctgatgtcactgacttctacgatcaattgtacattttgagagatttgtcctcttctttgaagcatgtcggaacc

SEQ ID NO: 74 - DNA, 2856 bp, Artificial Sequence
  Q9UVY5, Gibberella fujikuroi
atgccaggtaagatcgaaaacggtactccaaaggatttaaagactggtaacgatttcgtttctgctgccaagtctttgttggacagagctttcaaatctcaccactcttactacggtttatgttccacttcttgtcaagtttacgacactgcttgggttgccatgatcccaaagaccagagataatgtcaaacaatggttgttccctgaatgtttccactacttgttgaaaacccaagctgctgatggttcctggggttctttgccaaccactcaaaccgctggtatcttggataccgcttccgctgtcttggctttgctatgtcacgctcaagaaccattgcaaatcttggatgtttctccagatgaaatgggtttgagaatcgaacacggtgttacttctttgaagagacaattggctgtctggaacgacgtcgaggacactaaccacattggtgtcgaatttattattccagctttattgtccatgttggaaaaggaattggatgttccatctttcgaattcccatgtagatccatcttggaaagaatgcacggtgaaaagttgggtcacttcgatttggaacaagtctacggtaagccatcttctttactacattctttggaagctttcttaggtaagttagacttcgacagattgtcccaccacttgtaccacggttccatgatggcttctccatcctccactgctgcctacttgattggtgctaccaaatgggatgacgaagctgaggactacttgagacacgttatgagaaacggtgctggtcatggtaacggtggtatctccggtactttcccaaccacccatttcgaatgttcctggatcattgccactttgttgaaggttggtttcaccttgaaacaaattgacggtgacggtttgagaggtctatccactatcttattggaagctttacgtgacgaaaacggtgtcatcggtttcgctccaagaaccgctgatgtcgacgacaccgccaaggctttgttggctttgtctttagttaaccaacctgtctctccagatatcatgattaaggttttcgaaggtaaggaccattttaccactttcggttctgaacgtgatccatctttgacctctaacttgcacgtcttgttgtctttgttgaagcaatctaacttgtctcaataccatccacaaatcttaaagactactttgtttacctgtagatggtggtggggttctgaccattgtgtcaaggacaagtggaacttgtctcatttgtacccaaccatgttgttggtcgaagccttcactgaagtcttgcacttgattgacggtggtgaattgtcctctttgttcgatgaatctttcaaatgtaagatcggtttgtccattttccaagctgttttgagaatcatcttgactcaagacaacgatggttcctggagaggttacagagaacaaacctgttacgccattttggctttggtccaagctcgtcacgtttgtttcttcactcacatggtcgatagattacaatcttgtgtcgacagaggtttctcctggttaaagtcttgttccttccactctcaagacttgacttggacctccaagactgcttacgaagttggtttcgttgctgaagcctacaaattggctgctttgcaatctgcttctttggaagttccagctgctaccatcggtcactccgttacctctgctgtcccatcttctgacttggaaaagtacatgagattggtccgtaagactgctttgttctctccattggacgaatggggtttgatggcttccattattgaatcttctttctttgtcccattgttgcaagctcaaagagtcgaaatctacccaagagataatatcaaggttgacgaggacaagtacttgtccatcattccatttacctgggttggttgtaataacagatctagaactttcgcttctaacagatggttatatgacatgatgtacttatctttgttgggttaccaaactgacgaatacatggaagctgttgccggtccagttttcggtgatgtttctctattgcaccaaaccatcgacaaggttatcgacaacaccatgggtaacttggccagagccaacggtactgttcactctggtaacggtcaccaacacgaatctccaaacattggtcaagttgaggacactttgaccagattcaccaactccgttttgaaccacaaggacgtcttgaactcttcttcttctgaccaagataccttacgtcgtgaattcagaactttcatgcacgctcacatcacccaaatcgaagataactccagattctccaagcaagcctcctctgatgccttttcttctccagaacaatcttacttccaatgggttaactccactggtggttctcacgttgcttgtgcctactccttcgccttttccaactgtttgatgtccgctaacttattgcaaggtaaggatgctttcccatctggtactcaaaagtacttgatctcctccgtcatgagacacgctaccaacatgtgtcgtatgtacaacgatttcggttctattgccagagacaacgctgaaagaaacgttaactccattcacttccctgaattcactctatgtaacggtacttctcaaaacttggatgaaagaaaggaaagattattgaagatcgctacctacgaacaaggttacttggacagagctttggaagctttggaaagacaatccagagatgacgctggtgacagagctggttccaaggacatgagaaaattgaagattgtcaaattgttctgtgatgttaccgacttgtacgaccaattgtacgtcatcaaggacttgtcctcttccatgaag

SEQ ID NO: 75 - DNA, 2361 bp, Artificial Sequence
  O22667, Stevia rebaudiana
atgaagactggtttcatctctccagctaccgtcttccaccacagaatctctccagctaccactttcagacaccacttgtccccagctaccactaactctactggtattgttgctttgagagacatcaacttcagatgtaaagctgtttccaaggaatactctgacttgttgcaaaaggatgaagcctccttcaccaaatgggatgatgacaaagttaaggaccatttagacactaacaagaacttgtacccaaacgatgaaatcaaggaattcgtcgaatctgtcaaagctatgttcggttccatgaatgatggtgaaatcaacgtttccgcttacgacaccgcttgggttgctttggttcaagacgttgatggttccggttctccacaattcccatcttctttggaatggattgccaacaaccaattgtctgatggttcttggggtgaccatttgttattctctgctcacgacagaattattaacactttagcttgtgtcattgctttgacttcctggaatgtccatccatccaagtgtgaaaagggtttgaacttcttgagagaaaacatctgtaagttggaagatgaaaatgctgaacacatgccaattggtttcgaagttaccttcccatctttgattgatatcgccaagaagttgaacatcgaagtcccagaagacaccccagctttgaaggaaatctacgccagaagagatatcaagttgaccaaaatcccaatggaagttttgcacaaggttccaaccaccttgttgcactctttggaaggtatgccagacttggaatgggaaaagttgttaaagttgcaatgtaaggacggttctttcttgttctctccatcttctaccgcctttgctttgatgcaaactaaggacgaaaagtgtctacaatacttaactaatatcgttaccaaattcaacggtggtgtcccaaacgtttaccctgttgacttgtttgaacacatctgggttgttgacagattgcaacgtttgggtattgctcgttatttcaagtctgaaatcaaggactgtgttgaatacatcaacaagtactggactaagaacggtatctgttgggctcgtaacacccacgttcaagatatcgacgacactgctatgggtttcagagtcttgagagctcatggttacgatgtcaccccagatgtcttcagacaattcgaaaaggatggtaagttcgtttgttttgccggtcaatccactcaagccgtcactggtatgttcaacgtctacagagcttctcaaatgttgttcccaggtgaaagaatcctagaagacgctaagaagttctcctacaactacttgaaagaaaagcaatctactaacgaattgttggacaaatggatcattgccaaagacttaccaggtgaagtcggttacgctttggatattccatggtacgcttctctaccaagattagaaaccagatactacttggaacaatacggtggtgaagacgatgtctggatcggtaagaccttgtacagaatgggttacgtttccaacaacacttacttggaaatggccaaattggactacaacaactacgtcgccgtcttacaattggaatggtacaccattcaacaatggtacgttgacattggtattgaaaagtttgaatccgacaacatcaagtccgtcttggtttcctactacttggctgctgcttccatctttgaaccagaaagatccaaggaaagaattgcttgggctaagaccaccatcttggttgacaagatcacttctattttcgactcttcccaatcttccaaggaagatatcaccgctttcattgacaaattcagaaacaagtcttcttccaagaagcactccattaacggtgaaccatggcacgaagttatggttgctttgaagaagactttgcacggttttgctttggatgctttgatgactcactctcaagatattcaccctcaattacaccaagcttgggaaatgtggttaaccaagttgcaagatggtgtcgatgtcactgctgaattgatggttcaaatgatcaacatgactgccggtagatgggtttctaaggaattgttgactcaccctcaataccaacgtttgtccaccgtcaccaactctgtctgtcacgacatcactaagttgcacaacttcaaagaaaactccactactgtcgattctaaggttcaagaattggttcaattagttttctctgacaccccagatgacttggaccaagacatgaagcaaactttcttgactgtcatgaagaccttctactacaaggcttggtgtgacccaaacaccatcaacgaccatatttctaaggtcttcgaaattgttatc

SEQ ID NO: 76 - DNA, 2229 bp, Artificial Sequence
  O22667, Stevia rebaudiana
atgtgtaaagctgtttccaaggaatactctgacttgttgcaaaaggatgaagcctccttcaccaaatgggatgatgacaaagttaaggaccatttagacactaacaagaacttgtacccaaacgatgaaatcaaggaattcgtcgaatctgtcaaagctatgttcggttccatgaatgatggtgaaatcaacgtttccgcttacgacaccgcttgggttgctttggttcaagacgttgatggttccggttctccacaattcccatcttctttggaatggattgccaacaaccaattgtctgatggttcttggggtgaccatttgttattctctgctcacgacagaattattaacactttagcttgtgtcattgctttgacttcctggaatgtccatccatccaagtgtgaaaagggtttgaacttcttgagagaaaacatctgtaagttggaagatgaaaatgctgaacacatgccaattggtttcgaagttaccttcccatctttgattgatatcgccaagaagttgaacatcgaagtcccagaagacaccccagctttgaaggaaatctacgccagaagagatatcaagttgaccaaaatcccaatggaagttttgcacaaggttccaaccaccttgttgcactctttggaaggtatgccagacttggaatgggaaaagttgttaaagttgcaatgtaaggacggttctttcttgttctctccatcttctaccgcctttgctttgatgcaaactaaggacgaaaagtgtctacaatacttaactaatatcgttaccaaattcaacggtggtgtcccaaacgtttaccctgttgacttgtttgaacacatctgggttgttgacagattgcaacgtttgggtattgctcgttatttcaagtctgaaatcaaggactgtgttgaatacatcaacaagtactggactaagaacggtatctgttgggctcgtaacacccacgttcaagatatcgacgacactgctatgggtttcagagtcttgagagctcatggttacgatgtcaccccagatgtcttcagacaattcgaaaaggatggtaagttcgtttgttttgccggtcaatccactcaagccgtcactggtatgttcaacgtctacagagcttctcaaatgttgttcccaggtgaaagaatcctagaagacgctaagaagttctcctacaactacttgaaagaaaagcaatctactaacgaattgttggacaaatggatcattgccaaagacttaccaggtgaagtcggttacgctttggatattccatggtacgcttctctaccaagattagaaaccagatactacttggaacaatacggtggtgaagacgatgtctggatcggtaagaccttgtacagaatgggttacgtttccaacaacacttacttggaaatggccaaattggactacaacaactacgtcgccgtcttacaattggaatggtacaccattcaacaatggtacgttgacattggtattgaaaagtttgaatccgacaacatcaagtccgtcttggtttcctactacttggctgctgcttccatctttgaaccagaaagatccaaggaaagaattgcttgggctaagaccaccatcttggttgacaagatcacttctattttcgactcttcccaatcttccaaggaagatatcaccgctttcattgacaaattcagaaacaagtcttcttccaagaagcactccattaacggtgaaccatggcacgaagttatggttgctttgaagaagactttgcacggttttgctttggatgctttgatgactcactctcaagatattcaccctcaattacaccaagcttgggaaatgtggttaaccaagttgcaagatggtgtcgatgtcactgctgaattgatggttcaaatgatcaacatgactgccggtagatgggtttctaaggaattgttgactcaccctcaataccaacgtttgtccaccgtcaccaactctgtctgtcacgacatcactaagttgcacaacttcaaagaaaactccactactgtcgattctaaggttcaagaattggttcaattagttttctctgacaccccagatgacttggaccaagacatgaagcaaactttcttgactgtcatgaagaccttctactacaaggcttggtgtgacccaaacaccatcaacgaccatatttctaaggtcttcgaaattgttatc

SEQ ID NO: 77 - DNA, 2361 bp, Artificial Sequence
  O22667, Stevia rebaudiana
atgaaaaccggtttcatctctcccgccactgttttccaccaccgaatctcccccgccaccaccttccgacaccacctctcccctgccaccaccaactccactggtattgttgctctgcgagacatcaacttccgatgcaaggctgtttccaaggagtactccgatctgctccagaaggacgaggcctctttcaccaagtgggacgacgacaaggtcaaggaccacctcgacaccaacaagaacctctaccccaacgacgagatcaaggagtttgtcgagtccgtcaaggccatgttcggctccatgaacgacggcgagattaatgtctctgcttacgacaccgcctgggttgctctggtccaggatgtcgacggttccggctctcctcagttcccttcctctctcgagtggatcgccaacaaccagctgtccgacggttcttggggtgaccacctgctcttctctgctcacgaccgaatcatcaacaccctggcctgtgtcattgctctgacctcttggaacgtccacccctccaagtgcgagaagggtctgaacttcctccgagagaacatctgcaagctcgaggacgagaacgccgagcacatgcccattggcttcgaggtcaccttcccctctctgattgacattgccaagaagctcaacattgaggtccccgaggacacccccgctctcaaggagatctacgctcgacgagacatcaagctcaccaagatccccatggaggttctccacaaggtccccaccactctcctccactctctcgagggtatgcccgatctcgagtgggagaagctgctcaagctgcagtgcaaggacggctctttcctcttctccccctcttccactgccttcgccctcatgcagaccaaggacgagaagtgtctccagtacctcaccaacattgtcaccaagttcaacggtggtgtccccaacgtctaccccgttgacctctttgagcacatctgggttgttgaccgactccagcgactcggtatcgcccgatacttcaagtccgagatcaaggactgtgtcgagtacatcaacaagtactggaccaagaacggtatctgctgggcccgaaacacccacgtccaggacattgacgacaccgccatgggcttccgagttctgcgagcccacggctacgatgtcacccccgatgtctttcgacagtttgagaaggacggcaagtttgtctgtttcgccggtcagtccacccaggccgtcaccggtatgttcaacgtctaccgagcttctcagatgctcttccccggtgagcgaatcctcgaggacgccaagaagttctcctacaactacctcaaggagaagcagtccaccaacgagctgctcgacaagtggatcattgccaaggatctgcccggtgaggttggctacgccctcgacatcccctggtacgcctctctgccccgactggagactcgatactacctcgagcagtacggtggtgaggacgatgtctggatcggtaagaccctgtaccgaatgggctacgtttccaacaacacctacctcgagatggccaagctcgactacaacaactacgttgccgtcctccagctcgagtggtacaccatccagcagtggtacgtcgacattggtatcgagaagttcgagtccgacaacatcaagtccgtccttgtctcctactacctcgctgctgcctccatcttcgagcccgagcgatccaaggagcgaattgcctgggccaagaccaccatcctcgtcgacaagatcacctccatcttcgactcctcccagtcctccaaggaagatatcaccgccttcattgacaagttccgaaacaagtcctcctccaagaagcactccatcaacggcgagccctggcacgaggtcatggttgctctcaagaaaactctccacggctttgccctcgacgctctgatgacccactctcaggacatccacccccagctccaccaggcctgggagatgtggctcaccaagctccaggacggtgttgatgtcactgctgagctcatggtccagatgatcaacatgaccgccggccgatgggtttccaaggagctcctcacccacccccagtaccagcgactctccactgtcaccaactctgtctgccacgacatcaccaagctccacaacttcaaggagaactccaccaccgtcgactccaaggtccaggagctggtccagctcgttttctccgacacccccgatgatctcgaccaggacatgaagcagaccttcctgactgtcatgaaaactttctactacaaggcctggtgcgaccccaacaccatcaacgaccacatctccaaggtctttgagattgtgatt

SEQ ID NO: 78 - DNA, 2229 bp, Artificial Sequence
  O22667, Stevia rebaudiana
atgtgcaaggctgtttccaaggagtactccgatctgctccagaaggacgaggcctctttcaccaagtgggacgacgacaaggtcaaggaccacctcgacaccaacaagaacctctaccccaacgacgagatcaaggagtttgtcgagtccgtcaaggccatgttcggctccatgaacgacggcgagattaatgtctctgcttacgacaccgcctgggttgctctggtccaggatgtcgacggttccggctctcctcagttcccttcctctctcgagtggatcgccaacaaccagctgtccgacggttcttggggtgaccacctgctcttctctgctcacgaccgaatcatcaacaccctggcctgtgtcattgctctgacctcttggaacgtccacccctccaagtgcgagaagggtctgaacttcctccgagagaacatctgcaagctcgaggacgagaacgccgagcacatgcccattggcttcgaggtcaccttcccctctctgattgacattgccaagaagctcaacattgaggtccccgaggacacccccgctctcaaggagatctacgctcgacgagacatcaagctcaccaagatccccatggaggttctccacaaggtccccaccactctcctccactctctcgagggtatgcccgatctcgagtgggagaagctgctcaagctgcagtgcaaggacggctctttcctcttctccccctcttccactgccttcgccctcatgcagaccaaggacgagaagtgtctccagtacctcaccaacattgtcaccaagttcaacggtggtgtccccaacgtctaccccgttgacctctttgagcacatctgggttgttgaccgactccagcgactcggtatcgcccgatacttcaagtccgagatcaaggactgtgtcgagtacatcaacaagtactggaccaagaacggtatctgctgggcccgaaacacccacgtccaggacattgacgacaccgccatgggcttccgagttctgcgagcccacggctacgatgtcacccccgatgtctttcgacagtttgagaaggacggcaagtttgtctgtttcgccggtcagtccacccaggccgtcaccggtatgttcaacgtctaccgagcttctcagatgctcttccccggtgagcgaatcctcgaggacgccaagaagttctcctacaactacctcaaggagaagcagtccaccaacgagctgctcgacaagtggatcattgccaaggatctgcccggtgaggttggctacgccctcgacatcccctggtacgcctctctgccccgactggagactcgatactacctcgagcagtacggtggtgaggacgatgtctggatcggtaagaccctgtaccgaatgggctacgtttccaacaacacctacctcgagatggccaagctcgactacaacaactacgttgccgtcctccagctcgagtggtacaccatccagcagtggtacgtcgacattggtatcgagaagttcgagtccgacaacatcaagtccgtccttgtctcctactacctcgctgctgcctccatcttcgagcccgagcgatccaaggagcgaattgcctgggccaagaccaccatcctcgtcgacaagatcacctccatcttcgactcctcccagtcctccaaggaagatatcaccgccttcattgacaagttccgaaacaagtcctcctccaagaagcactccatcaacggcgagccctggcacgaggtcatggttgctctcaagaaaactctccacggctttgccctcgacgctctgatgacccactctcaggacatccacccccagctccaccaggcctgggagatgtggctcaccaagctccaggacggtgttgatgtcactgctgagctcatggtccagatgatcaacatgaccgccggccgatgggtttccaaggagctcctcacccacccccagtaccagcgactctccactgtcaccaactctgtctgccacgacatcaccaagctccacaacttcaaggagaactccaccaccgtcgactccaaggtccaggagctggtccagctcgttttctccgacacccccgatgatctcgaccaggacatgaagcagaccttcctgactgtcatgaaaactttctactacaaggcctggtgcgaccccaacaccatcaacgaccacatctccaaggtctttgagattgtgatt

SEQ ID NO: 79 - DNA, 2397 bp, Artificial Sequence
  Q9FXV9, Lactuca sativa (Garden Lettuce)
atgaaaaccatgatctcttctcccatccccgctttccacccccgattctctcctgctgctggctctcgacgactctcccccatcctcccctcttccggctccgtcgttctgaccggctccaagacccagtgcaaggctgtctccaagtcccccacccaggagtacttcgacgttctgcagaagaacggtctgcccttcatcaactggcagaacgacgttgtcgaggacgagctcgacaaggagaagaagattctctaccccaacgacgagatcaagggctttgtcgagcgaatcaaggtcatgctcggctccatggacgagggtgagatcactgtctccgcctacgacaccgcctgggttgctctcgtccaggacattgacggcaacggtcgacccgagttcccctcctctctcgagtggatcgtcaagaaccagctgtccgacggctcttggggtgaccacctcatcttctccgcccacgaccgaatcatcaacaccctcgcctgtgtcattgctctgacctcttggaacgtccaccccggcaagtgccagaagggtctgaagttcctcaacgacaacatctccaagctcgaagaggagaaccccgagcacatgcccattggtttcgaggttgccttcccctctctcattgacattgcccgaaagctcgatatccaggtccccgaggactcccctgctctcaaggagatctacgcccgacgaaacctcaagctcaccaagatccccaagtctctcatgcacaaggtccccaccactctgctgcactctctcgagggtatgcccgatctcgagtgggagaagctgctcaagctccagtgcaaggacggttccttcctcttctccccctcctccaccgccttcgccctcatgcagaccaaggaccagaagtgtctgcagtacctcaccgacgccgtcaccaagttcaacggtggtgtccccaacgtctaccccgtcgacctctttgagcacatctgggttgtcgaccgactgcagcgactcggtatctctcgatactttgactccgagatcaaggactgtgtcgactacatctaccgatactggaccaaggacggtatctgctgggccaagaactccaacgtccaggacattgacgacaccgccatgggcttccgagttctgcgaatgcacggctacaaggtcaccactgacgttttccgacagttcgagaaggacggcaagttcgtctgtttccccggccagaccacccaggccgtcaccggtatgttcaacctcttccgagcttcccaggttctcttccccgacgagaagattctcgaggacgccaagaagttctcctacaactacctcaaggagaagcagtccaccaacgagctcctcgacaagtggatcattgccaaggatctgcccggtgaggtcgagtacgccctcgatgtcccctggtacgcctctctgcctcgactcgagactcgattctacctcgagcagtacggtggcgaggacgatgtctggatcggtaagactctctaccgaatgggtaacgtttccaacaacacctacctcgagatggccaagctcgactacaacaactgtctggccatccaccacctcgagtggaacaccatgcagcagtggtacgtcgactttggtatggagcgattcggtacctccgatatcacctctctgcttgtctcttactacctcgccgctgcctccgtctttgagcccgagcgatccaaggagcgaattgcctgggccaagaccaccactctggtcgacaccatctcctccttcttccactctctcaagatctccaacgagcaccgacgagagtttgtcgaggagttccgaaacatctccaactccatccaccacgccaagtacggcaagccctggcacggtctgatggttgctctcaagggtactctgcacgagattgctctcgatgttctcatgacccaccgacgagacatccacccccagctccaccacgcctgggagatgtggctcatgcgatggcagcagggtgttgacgccaccgagggccaggctgagctcattgtccagaccatcaacatgaccgccggtcgatgggtttccaacgagctgctcgcccacccccagtaccgactcctctcctccgtcatcaacaacatctgccacgagatctaccacaaccgaacctgcatggaggtcaactccaccaccatctccacctccattgactccaagatgcaggagctcgtccagctggttctctccgactctctcgatgatctcgaccaggatctcaagcagaccttcctgaccgttgccaagaccttctactacaaggcctactgcgaccccgagactatcaacgtccacatctccaaggtcatgtttgagactattatt

SEQ ID NO: 80 - DNA, 2271 bp, Artificial Sequence
  Q9FXV9, Lactuca sativa (Garden Lettuce)
atgtgcaaggctgtctccaagtcccccacccaggagtacttcgacgttctgcagaagaacggtctgcccttcatcaactggcagaacgacgttgtcgaggacgagctcgacaaggagaagaagattctctaccccaacgacgagatcaagggctttgtcgagcgaatcaaggtcatgctcggctccatggacgagggtgagatcactgtctccgcctacgacaccgcctgggttgctctcgtccaggacattgacggcaacggtcgacccgagttcccctcctctctcgagtggatcgtcaagaaccagctgtccgacggctcttggggtgaccacctcatcttctccgcccacgaccgaatcatcaacaccctcgcctgtgtcattgctctgacctcttggaacgtccaccccggcaagtgccagaagggtctgaagttcctcaacgacaacatctccaagctcgaagaggagaaccccgagcacatgcccattggtttcgaggttgccttcccctctctcattgacattgcccgaaagctcgatatccaggtccccgaggactcccctgctctcaaggagatctacgcccgacgaaacctcaagctcaccaagatccccaagtctctcatgcacaaggtccccaccactctgctgcactctctcgagggtatgcccgatctcgagtgggagaagctgctcaagctccagtgcaaggacggttccttcctcttctccccctcctccaccgccttcgccctcatgcagaccaaggaccagaagtgtctgcagtacctcaccgacgccgtcaccaagttcaacggtggtgtccccaacgtctaccccgtcgacctctttgagcacatctgggttgtcgaccgactgcagcgactcggtatctctcgatactttgactccgagatcaaggactgtgtcgactacatctaccgatactggaccaaggacggtatctgctgggccaagaactccaacgtccaggacattgacgacaccgccatgggcttccgagttctgcgaatgcacggctacaaggtcaccactgacgttttccgacagttcgagaaggacggcaagttcgtctgtttccccggccagaccacccaggccgtcaccggtatgttcaacctcttccgagcttcccaggttctcttccccgacgagaagattctcgaggacgccaagaagttctcctacaactacctcaaggagaagcagtccaccaacgagctcctcgacaagtggatcattgccaaggatctgcccggtgaggtcgagtacgccctcgatgtcccctggtacgcctctctgcctcgactcgagactcgattctacctcgagcagtacggtggcgaggacgatgtctggatcggtaagactctctaccgaatgggtaacgtttccaacaacacctacctcgagatggccaagctcgactacaacaactgtctggccatccaccacctcgagtggaacaccatgcagcagtggtacgtcgactttggtatggagcgattcggtacctccgatatcacctctctgcttgtctcttactacctcgccgctgcctccgtctttgagcccgagcgatccaaggagcgaattgcctgggccaagaccaccactctggtcgacaccatctcctccttcttccactctctcaagatctccaacgagcaccgacgagagtttgtcgaggagttccgaaacatctccaactccatccaccacgccaagtacggcaagccctggcacggtctgatggttgctctcaagggtactctgcacgagattgctctcgatgttctcatgacccaccgacgagacatccacccccagctccaccacgcctgggagatgtggctcatgcgatggcagcagggtgttgacgccaccgagggccaggctgagctcattgtccagaccatcaacatgaccgccggtcgatgggtttccaacgagctgctcgcccacccccagtaccgactcctctcctccgtcatcaacaacatctgccacgagatctaccacaaccgaacctgcatggaggtcaactccaccaccatctccacctccattgactccaagatgcaggagctcgtccagctggttctctccgactctctcgatgatctcgaccaggatctcaagcagaccttcctgaccgttgccaagaccttctactacaaggcctactgcgaccccgagactatcaacgtccacatctccaaggtcatgtttgagactattatt

SEQ ID NO: 81 - DNA, 2283 bp, Artificial Sequence
  D2X8G0, Picea glauca
atgaagatgtccaagtccgtcgaggtccagcactgcgccgtccagttcctgtcctccaccaccgaccagattgagatccgagagcgaaacctccagatctccaccgaggccatgaagatgaagtcttggatcgagactgtcaagtacattctgcagtccatggaggacggtgagatcaccatctctgcttacgacactgcctggatcgccctcgtccccgctctcaacggctcttccgagccccagttcccctcttctctgcagtggctcatcaacaaccagctccaggacggctcttggggtgaccccctcatgttcctcatccgagatcgaatcatcaacaccctcgcctgtgtccttgctctcaagacctggaacatccactctctcggtgtcaacaagggtctgtccttcctccagacctacatccccaagatgaacgacgagcacgacgcccacacccccgttggctttgagattgtctttcctgctctcatggaggacgccaagatcatggagctcgatctgccctacgacgccgagttcctccagaagatctacgacgagcgagatctcaagatgaagcgaatccccatgaaggttctgcacgagttcccctccactctgctccactctctcgagggcctccgagacaaggtcaactgggaggagctcctcaagctccagtccaagaacggttccttcctcttctcccccgcctccaccgcctgtgctctggcccagacctccgacaccaactgtctgcgatacctcaacgagatcaccaagaagtacgacggtggtgctcccaacgtctaccccgttgacctctttgagcgactctggaccgtcgaccgaattgagcgactcggtattgcccgatactttgagtccgagatcaccgactctctcgagtacgtctaccgatactggaccaaccagggtattggctgggcccgagactcccccgtcaaggacgttgacgacacctccatggccttccgactgctgcgatcccacggcttcgatgtcactgccgaggccttcaaccacttcaagcaggacgaccagttcttctgcttctttggccagaccaagcagaccgtcaccggtatgtacaacctctaccgagcctcccagttctccttccccggtgagtccatcctcgaggaagctcgagtctttaccaagaacttcctcgaggagaagcgagctgagaagcagctgcgagacaagtggatcattgccaagggcctcaaggaagaggtcgagtacgctctcaagttcccctggtacgcctctcagcctcgaattgacacccgaatgtacatcaaccagtaccgagttgatgatgtctggatcggtaaggctctctaccgaatgcccattgtcaacaacaagacctacattgagctcgccaaggctgacttcaacatctgccagtccatccaccgaaccgagctccacggtatcatccgatggtaccgagagtccggtctggacgagctcggtctgcgacaggaccagattgtcaagtcttacttcctcgccgccattgccatctacgagcccgacatggcctccgcccgactcgcctgggccaagtctgctgttctcatggctgccatccgaatcttcttctccggtgagaactgctttgcccaccaccgacgacagttcctcgacgccttcacccgatgggacggccgagccatgcgagactcccccaactccgccaagcgactcttctcttgtctcttccgaatggtcaacctcttctccgtcgacggtgttgttgcccagggccgagacatctccggtgatctgcgacaccgatgggagcactggctcgcctccgaggccgaggatctgaccgacgcccaggaccacgagaagctcggtaccgaggctgagattgttgttctgaccgctgctttcctcggccgagagactatctcccccgatctcatctcccaccccgacttctcctccatcatgaaggtcaccaacaccgtctgctctctgctgcgacgaattgccacctacaaggaagagggctgcgactccccctccggtactgaagaggacgaccgactcaagcgacgagctgaagagggtatgggccaccttgtccgagccgtctaccgacaccagtactcccccgtcccctctggtgtcaagcgactctgtctggttgtcggcaagtctttctactacgccgcccactgcaacaacgaggaagtcggcaaccacgttgagactgttctcttccagcccgtgtat

SEQ ID NO: 82 - DNA, 1548 bp, Artificial Sequence
  Q45221, Bradyrhizobium japonicum
atgaacgccctctccgagcacattctgtccgagctccgacgactcctctccgagatgtccgacggtggttccgtcggcccctccgtctacgacaccgcccaggctctgcgattccacggtaacgtcaccggccgacaggacgcctacgcctggctcattgcccagcagcaggctgacggtggctggggttccgccgacttccctctcttccgacacgcccccacctgggctgctctgctcgctctgcagcgagccgaccccctccccggtgctgccgacgccgtccagaccgccacccgattcctccagcgacagcccgacccctacgcccacgccgtccccgaggacgcccccattggtgccgagctcatcctcccccagttctgcggtgaggctgcttctctgctcggtggtgttgccttcccccgacaccccgctctgctccccctccgacaggcctgtctggtcaagctcggtgccgtcgccatgctcccctccggccaccctctgctccactcttgggaggcctggggtacttctcccaccactgcctgccccgacgacgacggctccatcggtatctctcccgctgccaccgccgcctggcgagcccaggctgtcacccgaggctccactccccaggtcggccgagccgatgcctacctccagatggcctctcgagccacccgatccggtatcgagggtgttttccccaacgtctggcccatcaacgtctttgagccctgctggtccctctacaccctccacctcgccggcctcttcgcccaccccgctctcgccgaggctgtccgagtcatcgtcgcccagctcgacgcccgactcggtgtccacggtcttggccccgctctgcactttgctgccgacgccgacgacaccgccgttgctctctgtgttctgcacctcgccggccgagatcccgccgtcgatgctctgcgacactttgagattggtgagctcttcgtcaccttccccggtgagcgaaacgcctccgtttccaccaacatccacgccctccacgccctccgactcctcggcaagcccgctgccggtgcctccgcctacgtcgaggccaaccgaaacccccacggtctgtgggacaacgagaagtggcacgtcagctggctctaccccaccgcccacgccgttgctgctctcgcccagggcaagccccagtggcgagatgagcgagctctggctgctctgctccaggcccagcgagatgacggtggctggggtgctggccgaggctccaccttcgaggagactgcctacgccctcttcgccctccacgtcatggacggctctgaagaggccaccggccgacgacgaatcgcccaggttgttgcccgagctctcgagtggatgctcgcccgacacgccgcccacggtctgccccagacccctctgtggatcggtaaggagctctactgccccacccgagttgtccgagttgccgagctcgccggtctgtggctcgctctgcgatggggccgacgagtcctcgccgagggtgccggtgctgcccca

SEQ ID NO: 83 - DNA, 2838 bp, Artificial Sequence
  O13284, Phaeosphaeria sp
atgttcgccaagttcgacatgctcgaggaagaggcccgagctctggtccgaaaggtcggtaacgccgtcgaccccatctacggtttctccaccacctcctgccagatctacgacaccgcctgggccgccatgatctccaaagaggagcacggtgacaaggtctggctcttccccgagtccttcaagtacctcctcgagaagcagggtgaggacggctcttgggagcgacacccccgatccaagaccgtcggtgttctcaacaccgccgccgcctgtctggctctcctccgacacgtcaagaaccccctgcagctgcaggacattgctgcccaggacatcgagctccgaatccagcgaggtctgcgatctctcgaggagcagctcatcgcctgggatgacgttctggacaccaaccacattggtgtcgagatgattgtccccgctctgctcgactacctccaggccgaggacgagaacgtcgacttcgagtttgagtcccactctctgctcatgcagatgtacaaggagaagatggcccgattctcccccgagtctctctaccgagctcgaccctcttctgctctgcacaacctcgaggctctcatcggtaagctcgatttcgacaaggtcggccaccacctctacaacggctccatgatggcctccccctcttccactgccgccttcctcatgcacgcctctccctggtcccacgaggccgaggcctacctccgacacgtctttgaggctggtaccggcaagggctccggtggtttccccggtacctaccccaccacctactttgagctcaactgggtcctctccaccctcatgaagtccggcttcactctctccgatctcgagtgcgacgagctctcctccattgccaacaccatcgccgagggtttcgagtgcgaccacggtgtcatcggtttcgctccccgagccgtcgacgttgatgacactgccaagggtctgctcaccctcaccctcctcggtatggacgagggtgtctcccccgctcccatgattgccatgttcgaggccaaggaccacttcctgaccttcctcggtgagcgagatccctccttcacctccaactgccacgttctgctctctctgctccaccgaaccgacctcctccagtacctcccccagatccgaaagaccaccaccttcctctgtgaggcctggtgggcctgcgacggccagatcaaggacaagtggcacctctcccacctctaccccaccatgctcatggtccaggcctttgccgagatcctcctcaagtccgccgagggtgagcctctgcacgacgcctttgacgccgccactctgtctcgagtctccatctgtgttttccaggcctgtctgcgaactctgctcgcccagtcccaggacggctcttggcacggccagcccgaggcttcttgctacgccgtcctcaccctcgccgagtccggccgacttgttctgctccaggctctgcagccccagattgctgctgccatggagaaggctgctgatgtcatgcaggctggtcgatggtcttgttccgaccacgactgtgactggacctccaagaccgcctaccgagtcgacctcgttgctgctgcttaccgactcgccgccatgaaggcctcttccaacctcaccttcaccgtcgacgacaacgtttccaagcgatccaacggtttccagcagctcgtcggccgaaccgacctcttctccggtgtccccgcctgggagctccaggcctctttcctcgagtccgctctgtttgtccctctgctccgaaaccaccgactcgatgtctttgaccgagatgatatcaaggtttccaaggaccactacctcgatatgatccccttcacctgggtcggctgcaacaaccgatctcgaacctacgtttccacctccttcctcttcgacatgatgatcatctccatgctcggctaccagattgacgagttcttcgaggctgaggctgcccccgccttcgcccagtgcatcggtcagctccaccaggttgttgacaaggtcgtcgacgaggtcattgacgaggttgtcgacaaggttgtcggtaaggtcgtcggtaaggtcgtcggcaaggtcgtcgacgagcgagtcgactcccccacccacgaggccatcgccatctgcaacatcgaggcttctctgcgacgattcgtcgaccacgttctccaccaccagcacgttctgcacgcctcccagcaggagcaggatatcctctggcgagagctccgagccttcctgcacgcccacgttgtccagatggccgacaactccactctcgctcctcccggccgaaccttctttgactgggtccgaaccactgctgccgaccacgttgcctgtgcctactccttcgccttcgcctgctgcatcacctccgccaccattggccagggccagtccatgtttgccaccgtcaacgagctctacctggtccaggctgctgcccgacacatgaccaccatgtgccgaatgtgcaacgacattggctccgtcgaccgagacttcattgaggccaacatcaactccgtccacttccccgagttctccactctgtctctcgttgctgacaagaagaaggctctggcccgactcgccgcctacgagaagtcttgtctgacccacaccctcgaccagtttgagaacgaggttctccagtctccccgagtctcctccgccgcctccggtgacttccgaacccgaaaggtcgccgttgtccgattcttcgccgatgtcactgacttctacgaccagctctacatcctccgagatctgtcctcctctctcaagcacgtcgggaca

SEQ ID NO: 84 - DNA, 2856 bp, Artificial Sequence
  Q9UVY5, Gibberella fujikuroi
atgcccggcaagattgagaacggtacccccaaggacctcaagaccggcaacgacttcgtttccgctgccaagtctctgctcgaccgagccttcaagtcccaccactcctactacggtctgtgctccacttcctgccaggtctacgacaccgcctgggttgccatgatccccaagacccgagacaacgtcaagcagtggctcttccccgagtgtttccactacctgctcaagacccaggctgctgacggctcttggggctctctgcccaccacccagaccgccggtatcctcgacactgcctccgccgttctggctctgctctgccacgcccaggagcctctgcagatcctcgatgtctcccccgatgagatgggtctgcgaatcgagcacggtgtcacttctctcaagcgacagctcgccgtctggaacgacgttgaggacaccaaccacattggtgtcgagttcatcatccccgctctgctctccatgctcgagaaggagctcgatgtcccctccttcgagttcccttgccgatccattctggagcgaatgcacggcgagaagctcggtcactttgatctcgagcaggtctacggcaagccctcttctctgctgcactctctcgaggccttcctcggcaagctcgatttcgaccgactctcccaccacctctaccacggctccatgatggcctccccctcttccaccgccgcctacctcattggtgccaccaagtgggacgacgaggccgaggactacctccgacacgtcatgcgaaacggtgccggccacggtaacggtggtatctctggtaccttccccaccacccactttgagtgctcctggatcattgccactctcctcaaggtcggtttcactctcaagcagattgacggtgacggtctgcgaggcctctccaccattctcctcgaggctctgcgtgacgagaacggtgtcattggcttcgctccccgaaccgccgacgttgatgacactgccaaggctctgctggctctgtctctggtcaaccagcccgtttcccccgacatcatgatcaaggttttcgagggtaaggaccacttcaccacctttggctccgagcgagatccctctctgacctccaacctccacgttctcctctctctgctcaagcagtccaacctgtctcagtaccacccccagatcctcaagaccactctcttcacctgtcgatggtggtggggctccgaccactgtgtcaaggacaagtggaacctctcccacctctaccccaccatgctcctcgtcgaggccttcaccgaggttctgcacctcatcgacggtggtgagctctcctctctgtttgacgagtctttcaagtgcaagatcggtctgtccatcttccaggccgttctccgaatcatcctcacccaggacaacgacggctcttggcgaggctaccgagagcagacctgttacgccattctcgccctcgtccaggcccgacacgtctgtttcttcacccacatggtcgaccgactccagtcctgtgtcgaccgaggtttctcttggctcaagtcttgctccttccactctcaggacctcacctggacctccaagaccgcttacgaggttggtttcgttgccgaggcctacaagctcgctgctctccagtccgcctctctcgaggtccccgctgccaccatcggccactccgtcacctctgctgtcccctcctccgatctcgagaagtacatgcgactcgtccgaaagaccgctctgttctctcccctcgatgagtggggtctgatggcctccatcatcgagtcctccttctttgtccccctcctccaggcccagcgagttgagatctacccccgagacaacatcaaggtcgacgaggacaagtacctctccatcatccccttcacctgggttggctgcaacaaccgatctcgaacctttgcctccaaccgatggctctacgacatgatgtacctgtctctgctcggctaccagaccgacgagtacatggaggccgttgccggccccgtctttggtgatgtctctctgctgcaccagaccatcgacaaggtcattgacaacaccatgggtaacctggcccgagccaacggtaccgtccactccggcaacggtcaccagcacgagtcccccaacattggccaggtcgaggacaccctcactcgatttaccaactccgtcctcaaccacaaggacgtcctcaactcctcctcctccgaccaggacaccctccgacgagagttccgaaccttcatgcacgcccacatcacccagatcgaggacaactcccgattctccaagcaggcttcttccgacgccttctcctcccccgagcagtcctacttccagtgggtcaactccactggtggttcccacgttgcctgcgcctactctttcgccttctccaactgcctcatgtccgccaacctcctccagggtaaggacgccttcccttccggtacccagaagtacctcatctcctccgtcatgcgacacgccaccaacatgtgccgaatgtacaacgatttcggttccatcgcccgagacaacgccgagcgaaacgtcaactccatccactttcccgagttcactctctgtaacggtacctcccagaacctcgacgagcgaaaggagcgactcctcaagattgctacttacgagcagggctacctcgaccgagctctcgaggctctggagcgacagtcccgagatgatgctggtgaccgagccggctccaaggacatgcgaaagctcaagattgtcaagctcttctgtgacgtcaccgacctctacgaccagctctacgtcatcaaggacctctcctcctccatgaaa

SEQ ID NO: 85 - DNA, 2979 bp, Artificial Sequence
  Synthetic construct
cccactagttataaagtcacaagtatctcagtatacccgtctaaccacacatttatcaccatgcccggcaagattgagaacggtacccccaaggacctcaagaccggcaacgacttcgtttccgctgccaagtctctgctcgaccgagccttcaagtcccaccactcctactacggtctgtgctccacttcctgccaggtctacgacaccgcctgggttgccatgatccccaagacccgagacaacgtcaagcagtggctcttccccgagtgtttccactacctgctcaagacccaggctgctgacggctcttggggctctctgcccaccacccagaccgccggtatcctcgacactgcctccgccgttctggctctgctctgccacgcccaggagcctctgcagatcctcgatgtctcccccgatgagatgggtctgcgaatcgagcacggtgtcacttctctcaagcgacagctcgccgtctggaacgacgttgaggacaccaaccacattggtgtcgagttcatcatccccgctctgctctccatgctcgagaaggagctcgatgtcccctccttcgagttcccttgccgatccattctggagcgaatgcacggcgagaagctcggtcactttgatctcgagcaggtctacggcaagccctcttctctgctgcactctctcgaggccttcctcggcaagctcgatttcgaccgactctcccaccacctctaccacggctccatgatggcctccccctcttccaccgccgcctacctcattggtgccaccaagtgggacgacgaggccgaggactacctccgacacgtcatgcgaaacggtgccggccacggtaacggtggtatctctggtaccttccccaccacccactttgagtgctcctggatcattgccactctcctcaaggtcggtttcactctcaagcagattgacggtgacggtctgcgaggcctctccaccattctcctcgaggctctgcgtgacgagaacggtgtcattggcttcgctccccgaaccgccgacgttgatgacactgccaaggctctgctggctctgtctctggtcaaccagcccgtttcccccgacatcatgatcaaggttttcgagggtaaggaccacttcaccacctttggctccgagcgagatccctctctgacctccaacctccacgttctcctctctctgctcaagcagtccaacctgtctcagtaccacccccagatcctcaagaccactctcttcacctgtcgatggtggtggggctccgaccactgtgtcaaggacaagtggaacctctcccacctctaccccaccatgctcctcgtcgaggccttcaccgaggttctgcacctcatcgacggtggtgagctctcctctctgtttgacgagtctttcaagtgcaagatcggtctgtccatcttccaggccgttctccgaatcatcctcacccaggacaacgacggctcttggcgaggctaccgagagcagacctgttacgccattctcgccctcgtccaggcccgacacgtctgtttcttcacccacatggtcgaccgactccagtcctgtgtcgaccgaggtttctcttggctcaagtcttgctccttccactctcaggacctcacctggacctccaagaccgcttacgaggttggtttcgttgccgaggcctacaagctcgctgctctccagtccgcctctctcgaggtccccgctgccaccatcggccactccgtcacctctgctgtcccctcctccgatctcgagaagtacatgcgactcgtccgaaagaccgctctgttctctcccctcgatgagtggggtctgatggcctccatcatcgagtcctccttctttgtccccctcctccaggcccagcgagttgagatctacccccgagacaacatcaaggtcgacgaggacaagtacctctccatcatccccttcacctgggttggctgcaacaaccgatctcgaacctttgcctccaaccgatggctctacgacatgatgtacctgtctctgctcggctaccagaccgacgagtacatggaggccgttgccggccccgtctttggtgatgtctctctgctgcaccagaccatcgacaaggtcattgacaacaccatgggtaacctggcccgagccaacggtaccgtccactccggcaacggtcaccagcacgagtcccccaacattggccaggtcgaggacaccctcactcgatttaccaactccgtcctcaaccacaaggacgtcctcaactcctcctcctccgaccaggacaccctccgacgagagttccgaaccttcatgcacgcccacatcacccagatcgaggacaactcccgattctccaagcaggcttcttccgacgccttctcctcccccgagcagtcctacttccagtgggtcaactccactggtggttcccacgttgcctgcgcctactctttcgccttctccaactgcctcatgtccgccaacctcctccagggtaaggacgccttcccttccggtacccagaagtacctcatctcctccgtcatgcgacacgccaccaacatgtgccgaatgtacaacgatttcggttccatcgcccgagacaacgccgagcgaaacgtcaactccatccactttcccgagttcactctctgtaacggtacctcccagaacctcgacgagcgaaaggagcgactcctcaagattgctacttacgagcagggctacctcgaccgagctctcgaggctctggagcgacagtcccgagatgatgctggtgaccgagccggctccaaggacatgcgaaagctcaagattgtcaagctcttctgtgacgtcaccgacctctacgaccagctctacgtcatcaaggacctctcctcctccatgaaataactatccgaagatcaagagcgaagcaagttgtaagtccaggacatgtttcccgcccacgcg

SEQ ID NO: 86 - protein, 788 aa, Artificial Sequence
  Q9FXV8, Lactuca sativa (Garden Lettuce)
MNIAQITSSAMLVPSSHIPHRSWVVNCCMVQYNPSGLRTASSQAGQVNPTVMTLDVTKERIRKLFNNVEVSVSSYDTAWVAMVPSPNSPKSPCFPDCLNWLLDNQLDDGSWGLLPHQSPLIKDTLSSTLACVLALKRWNVGKDQINKGLHYIESNFASVTDKNQASPFGFDIIFPGMLEYAKDLDIKLPLNQTHLSVMLHERELELRRCHSNGREAYLAYISEGLGNLNDWNMVMKYQMKNGSLFNSPSATASVLIHHQNAGCLHYLTSLLDKFGNAVPTVYPIDLYVRLSMVDTLERLGIKRHFMVEIQNVLDETYRCWVQGDVQIFMDVVTCALAFRVLRSNGYEVSSDPLAKITKEGDYMNSPEKPFKDVYTSLEVYKASQIIYQEELAFREQNLTSYLPSSNKLSNYILKEVDDALKFPFNGSLERMSTRRNIEHYNLNHTRILKTTYSSSNISNKDYLKLAVQDFNECQSIYCEELKDLERWVVENRLDKLKFARQKTAYCYFSAASFLSSPDLSDARISWAKSSILTTVIDDFFDVGGSMDELVNFVHIIEKWNVNVENDCCSEEVGVLFLALKDAVCWIGDKAFKIQERNITSHVIEIWLDLVKSMLREAIWAKDGSIPTINEYMENGYVSFALGPIVLPTLYFLGVKLSEEVVQSSEYHKLYEVMSTQGRLMNDIHSFKREKKAGKLNAVALYMSDGKSGSVEEEVVEEMKILTKSQRKEMMKLVLETKGSVVPRVCKDVFWNMCNVLNLFYATDDGFTGNAILDVVKEIIYEPVSHELI

SEQ ID NO: 87 - protein, 750 aa, Artificial Sequence
  Q9FXV8, Lactuca sativa (Garden Lettuce)
MASSQAGQVNPTVMTLDVTKERIRKLFNNVEVSVSSYDTAWVAMVPSPNSPKSPCFPDCLNWLLDNQLDDGSWGLLPHQSPLIKDTLSSTLACVLALKRWNVGKDQINKGLHYIESNFASVTDKNQASPFGFDIIFPGMLEYAKDLDIKLPLNQTHLSVMLHERELELRRCHSNGREAYLAYISEGLGNLNDWNMVMKYQMKNGSLFNSPSATASVLIHHQNAGCLHYLTSLLDKFGNAVPTVYPIDLYVRLSMVDTLERLGIKRHFMVEIQNVLDETYRCWVQGDVQIFMDVVTCALAFRVLRSNGYEVSSDPLAKITKEGDYMNSPEKPFKDVYTSLEVYKASQIIYQEELAFREQNLTSYLPSSNKLSNYILKEVDDALKFPFNGSLERMSTRRNIEHYNLNHTRILKTTYSSSNISNKDYLKLAVQDFNECQSIYCEELKDLERWVVENRLDKLKFARQKTAYCYFSAASFLSSPDLSDARISWAKSSILTTVIDDFFDVGGSMDELVNFVHIIEKWNVNVENDCCSEEVGVLFLALKDAVCWIGDKAFKIQERNITSHVIEIWLDLVKSMLREAIWAKDGSIPTINEYMENGYVSFALGPIVLPTLYFLGVKLSEEVVQSSEYHKLYEVMSTQGRLMNDIHSFKREKKAGKLNAVALYMSDGKSGSVEEEVVEEMKILTKSQRKEMMKLVLETKGSVVPRVCKDVFWNMCNVLNLFYATDDGFTGNAILDVVKEIIYEPVSHELI

SEQ ID NO: 88 - protein, 757 aa, Artificial Sequence
  D2X8G1, Picea glauca
MKREQYTILNEKESMAEELILRIKRMFSEIENTQTSASAYDTAWVAMVPSLDSSQQPQFPQCLSWIIDNQLLDGSWGIPYLIIKDRLCHTLACVIALRKWNAGNQNVETGLRFLRENIEGIVHEDEYTPIGFQIIFPAMLEEARGLGLELPYDLTPIKLMLTHREKIMKGKAIDHMHEYDSSLIYTVEGIHKIVDWNKVLKHQNKDGSLFNSPSATACALMHTRKSNCLEYLSSMLQKLGNGVPSVYPINLYARISMIDRLQRLGLARHFRNEIIHALDDIYRYWMQKETSREGKSLTPDIVSTSIAFMLLRLHGYDVPADVFCCYHLHSIEQSGEAVTAMLSLYRASQIMFPGETILEEIKTVSRKYLDKRKENGRIYYHNIVMKDLRGEVEYALSVPWYASLERIENRRYIDQYGVNDTWIAKTSYKIPCISNDLFLALAKQDYNICQAIQQKELRELERWFADNKFSHLNFARQKLIYCYFSAAATLFSPELSAARVVWAKNGVITTVVDDFFDVGGSSEEIHSFVEAVRVWDEAATDGLSENVQILFSALYNTVDEIVQQAFVFQGRDISIHLREIWYRLVNSMMTEAQWARTHCIPSMHEYMENAEPSIALEPIVLSSLYFVGPKLSEEIICHPEYYNLMHLLNICGRLLNDIQGCKREAHQGKLNSVTLYMEENSGTTMEDAIVYLRKTIDESRQLLLKEVLRPSIVPRECKQLHWNMMRILQLFYLKNDGFTSPTEMLGYVNAVIVDPIL

SEQ ID NO: 89 - protein, 300 aa, Artificial Sequence
  Q45222, Bradyrhizobium japonicum
MIQTERAVQQVLEWGRSLTGFADEHAVEAVRGGQYILQRIHPSLRGTSARTGRDPQDETLIVTFYRELALLFWLDDCNDLGLISPEQLAAVEQALGQGVPCALPGFEGCAVLRASLATLAYDRRDYAQLLDDTRCYSAALRAGHAQAVAAERWSYAEYLHNGIDSIAYANVFCCLSLLWGLDMATLRARPAFRQVLRLISAIGRLQNDLHGCDKDRSAGEADNAVILLLQRYPAMPVVEFLNDELAGHTRMLHRVMAEERFPAPWGPLIEAMAAIRVQYYRTSTSRYRSDAVRGGQRAPA

SEQ ID NO: 90 - protein, 946 aa, Artificial Sequence; identical to SEQ ID NO: 65
  O13284, Phaeosphaeria sp

SEQ ID NO: 91 - protein, 952 aa, Artificial Sequence; identical to SEQ ID NO: 66
  Q9UVY5, Gibberella fujikuroi

SEQ ID NO: 92 - protein, 784 aa, Artificial Sequence
  Q9XEI0, Stevia rebaudiana
MNLSLCIASPLLTKSNRPAALSAIHTASTSHGGQTNPTNLIIDTTKERIQKQFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATEKSQPSPIGFDIIFPGLLEYAKNLDINLLSKQTDFSLMLHKRELEQKRCHSNEMDGYLAYISEGLGNLYDWNMVKKYQMKNGSVFNSPSATAAAFINHQNPGCLNYLNSLLDKFGNAVPTVYPHDLFIRLSMVDTIERLGISHHFRVEIKNVLDETYRCWVERDEQIFMDVVTCALAFRLLRINGYEVSPDPLAEITNELALKDEYAALETYHASHILYQEDLSSGKQILKSADFLKEIISTDSNRLSKLIHKEVENALKFPINTGLERINTRRNIQLYNVDNTRILKTTYHSSNISNTDYLRLAVEDFYTCQSIYREELKGLERWVVENKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 93 - protein, 757 aa, Artificial Sequence
  Q9XEI0, Stevia rebaudiana
MTSHGGQTNPTNLIIDTTKERIQKQFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATEKSQPSPIGFDIIFPGLLEYAKNLDINLLSKQTDFSLMLHKRELEQKRCHSNEMDGYLAYISEGLGNLYDWNMVKKYQMKNGSVFNSPSATAAAFINHQNPGCLNYLNSLLDKFGNAVPTVYPHDLFIRLSMVDTIERLGISHHFRVEIKNVLDETYRCWVERDEQIFMDVVTCALAFRLLRINGYEVSPDPLAEITNELALKDEYAALETYHASHILYQEDLSSGKQILKSADFLKEIISTDSNRLSKLIHKEVENALKFPINTGLERINTRRNIQLYNVDNTRILKTTYHSSNISNTDYLRLAVEDFYTCQSIYREELKGLERWVVENKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 94 - DNA, 2364 bp, Artificial Sequence
  Q9FXV8, Lactuca sativa (Garden Lettuce)
atgaacattgctcaaatcacctcttctgctatgttggttccatcttctcacatcccacaccgttcctgggttgtcaactgttgtatggttcaatacaacccatccggtctaagaactgcttcctctcaagccggtcaagtcaacccaactgttatgactttggatgtcactaaggaaagaatcagaaagttgttcaacaacgtcgaagtttctgtttcctcttacgacaccgcttgggttgccatggttccatctccaaactctccaaagtccccatgtttcccagactgtttgaactggttgttggacaaccaattggatgatggttcctggggtttgttgccacaccaatctccattgatcaaagacactttatcttctactttggcttgtgttttggctttaaagagatggaacgtcggtaaggatcaaatcaacaagggtttacattacatcgaatccaactttgcttccgtcactgataagaaccaagcctctccattcggttttgacatcattttcccaggtatgttggaatacgccaaggatttggacattaaattgcctttgaaccaaactcacttgtccgtcatgttgcacgaaagagaattggaattgagaagatgtcactctaacggtcgtgaagcctacttagcttacatttccgaaggtttgggtaacttgaacgactggaacatggttatgaagtaccaaatgaagaacggttctttgttcaactctccttctgctactgcttctgttttgattcaccaccaaaatgctggttgtttgcactacttaacctccctattggacaagtttggtaatgctgtcccaactgtttacccaatcgacttgtacgttagattgtccatggttgacactttggaaagattgggtatcaagagacatttcatggttgaaattcaaaatgtcttggacgaaacctacagatgttgggttcaaggtgatgttcaaatcttcatggatgtcgttacctgtgctttggctttcagagttctacgttctaacggttacgaagtctcttctgacccattggctaagattaccaaagaaggtgactacatgaactctccagaaaagcctttcaaggacgtctacacctctttggaagtctacaaggcttctcaaatcatctaccaagaagaattggccttcagagaacaaaacttgacctcttatttgccatcttctaacaaattgtccaactacattttgaaggaagttgatgacgctttgaagttcccattcaatggttctctagaaagaatgtccactagaagaaacattgaacactacaacttgaaccacaccagaattttgaagaccacctactcctcttccaacatttccaacaaggactacttgaaattagccgtccaagacttcaacgaatgtcaatccatctactgtgaagaattaaaggacttggaaagatgggttgtcgaaaacagattagacaagttgaaatttgctcgtcaaaagaccgcttactgttacttctctgctgcttctttcttatcttctccagatttgtccgatgctagaatctcctgggctaaatcttccattttgactaccgtcattgatgatttctttgacgtcggtggttccatggatgaattggttaacttcgtccacatcatcgaaaagtggaacgtcaacgttgaaaacgattgttgttctgaagaagtcggtgttttgttcttggctttaaaggatgctgtctgttggattggtgacaaggctttcaagatccaagaaagaaacatcacttcccacgtcattgaaatctggttggacttggttaagtccatgttgagagaagctatttgggctaaggacggttccatcccaaccatcaacgaatacatggaaaacggttacgtttctttcgccttgggtccaatcgttttgccaactttgtacttcttaggtgtcaagttgtctgaagaagtcgtccaatcttccgaataccacaagttgtacgaagttatgtccacccaaggtagattgatgaacgacattcactctttcaaacgtgaaaagaaggccggtaagttgaatgctgttgctttatacatgtccgacggtaaatctggttctgttgaagaagaagttgtcgaagaaatgaagatcttgactaaatctcaaagaaaggaaatgatgaagttggttttggaaaccaagggttccgttgtcccaagagtttgtaaggacgttttctggaacatgtgtaacgtcttgaacttgttctacgctaccgatgacggtttcactggtaacgccatcttagatgttgtcaaggaaatcatctacgaaccagtctctcatgaattgata

SEQ ID NO: 95 - DNA, 2250 bp, Artificial Sequence
  Q9FXV8, Lactuca sativa (Garden Lettuce)
atggcttcctctcaagccggtcaagtcaacccaactgttatgactttggatgtcactaaggaaagaatcagaaagttgttcaacaacgtcgaagtttctgtttcctcttacgacaccgcttgggttgccatggttccatctccaaactctccaaagtccccatgtttcccagactgtttgaactggttgttggacaaccaattggatgatggttcctggggtttgttgccacaccaatctccattgatcaaagacactttatcttctactttggcttgtgttttggctttaaagagatggaacgtcggtaaggatcaaatcaacaagggtttacattacatcgaatccaactttgcttccgtcactgataagaaccaagcctctccattcggttttgacatcattttcccaggtatgttggaatacgccaaggatttggacattaaattgcctttgaaccaaactcacttgtccgtcatgttgcacgaaagagaattggaattgagaagatgtcactctaacggtcgtgaagcctacttagcttacatttccgaaggtttgggtaacttgaacgactggaacatggttatgaagtaccaaatgaagaacggttctttgttcaactctccttctgctactgcttctgttttgattcaccaccaaaatgctggttgtttgcactacttaacctccctattggacaagtttggtaatgctgtcccaactgtttacccaatcgacttgtacgttagattgtccatggttgacactttggaaagattgggtatcaagagacatttcatggttgaaattcaaaatgtcttggacgaaacctacagatgttgggttcaaggtgatgttcaaatcttcatggatgtcgttacctgtgctttggctttcagagttctacgttctaacggttacgaagtctcttctgacccattggctaagattaccaaagaaggtgactacatgaactctccagaaaagcctttcaaggacgtctacacctctttggaagtctacaaggcttctcaaatcatctaccaagaagaattggccttcagagaacaaaacttgacctcttatttgccatcttctaacaaattgtccaactacattttgaaggaagttgatgacgctttgaagttcccattcaatggttctctagaaagaatgtccactagaagaaacattgaacactacaacttgaaccacaccagaattttgaagaccacctactcctcttccaacatttccaacaaggactacttgaaattagccgtccaagacttcaacgaatgtcaatccatctactgtgaagaattaaaggacttggaaagatgggttgtcgaaaacagattagacaagttgaaatttgctcgtcaaaagaccgcttactgttacttctctgctgcttctttcttatcttctccagatttgtccgatgctagaatctcctgggctaaatcttccattttgactaccgtcattgatgatttctttgacgtcggtggttccatggatgaattggttaacttcgtccacatcatcgaaaagtggaacgtcaacgttgaaaacgattgttgttctgaagaagtcggtgttttgttcttggctttaaaggatgctgtctgttggattggtgacaaggctttcaagatccaagaaagaaacatcacttcccacgtcattgaaatctggttggacttggttaagtccatgttgagagaagctatttgggctaaggacggttccatcccaaccatcaacgaatacatggaaaacggttacgtttctttcgccttgggtccaatcgttttgccaactttgtacttcttaggtgtcaagttgtctgaagaagtcgtccaatcttccgaataccacaagttgtacgaagttatgtccacccaaggtagattgatgaacgacattcactctttcaaacgtgaaaagaaggccggtaagttgaatgctgttgctttatacatgtccgacggtaaatctggttctgttgaagaagaagttgtcgaagaaatgaagatcttgactaaatctcaaagaaaggaaatgatgaagttggttttggaaaccaagggttccgttgtcccaagagtttgtaaggacgttttctggaacatgtgtaacgtcttgaacttgttctacgctaccgatgacggtttcactggtaacgccatcttagatgttgtcaaggaaatcatctacgaaccagtctctcatgaattgata

SEQ ID NO: 96 - DNA, 2271 bp, Artificial Sequence
  D2X8G1, Picea glauca
atgaagagagaacaatacactatcttgaacgaaaaggaatccatggctgaagaattaatcttgagaatcaagagaatgttttctgaaatcgaaaacactcaaacctctgcttctgcttacgacaccgcttgggttgccatggttccatctttggactcctctcaacaaccacaattccctcaatgtttgtcctggatcattgacaaccaattgttggatggttcctggggtatcccatacttgatcatcaaggacagactatgtcacactttagcttgtgtcattgctttgagaaaatggaacgctggtaaccaaaatgtcgaaaccggtctacgtttcttgagagaaaacattgaaggtatcgttcacgaagatgaatacactccaattggtttccaaatcattttcccagctatgttggaagaagctcgtggtttaggtctagaattgccatacgacttgactccaatcaagttgatgttgacccacagagaaaagatcatgaagggtaaggccattgaccacatgcacgaatacgactcttctttgatctacactgttgaaggtatccacaagatcgttgactggaacaaggttttgaaacatcaaaacaaggatggttctttgttcaactctccatctgctactgcttgtgctttgatgcacactagaaagtccaactgtttggaatacttgtcctccatgttgcaaaagttaggtaacggtgttccatccgtctacccaatcaacttatatgctcgtatctccatgattgacagattacaaagattaggtttggctagacatttcagaaacgaaatcattcacgctttggacgacatctacagatactggatgcaaaaggaaacctccagagaaggtaagtctttgaccccagatattgtctctacttccatcgctttcatgttgttgagattgcacggttacgatgttccagctgatgttttctgttgttaccatttgcactccattgaacaatctggtgaagccgttactgctatgttgtctttgtacagagcctctcaaattatgttcccaggtgaaaccattttggaagaaatcaagaccgtttctagaaagtacttggacaagagaaaggaaaacggtcgtatctactaccacaacattgttatgaaggacttgagaggtgaagtcgaatacgccttgtctgttccatggtacgcttccttggaaagaattgaaaacagaagatacattgaccaatacggtgtcaacgatacctggatcgctaagacctcttacaaaatcccatgtatctccaatgacttattcttggctttggccaagcaagactacaacatctgtcaagccattcaacaaaaggaattgagagaattggaaagatggtttgctgataacaaattctctcacttgaacttcgctcgtcaaaagttgatctactgttacttctctgccgctgctactttgttctctccagaattgtctgctgccagagttgtctgggctaagaacggtgttatcaccaccgtcgttgatgacttcttcgatgtcggtggttcttctgaagaaattcactctttcgtcgaagctgttagagtctgggacgaagctgctaccgatggtttgtctgaaaacgttcaaatcttattctccgctttatacaacaccgtcgacgaaattgtccaacaagccttcgttttccaaggtagagacatctccattcacttgagagaaatctggtacagattggtcaactccatgatgactgaagctcaatgggctagaactcactgtattccatccatgcacgaatacatggaaaacgctgaaccttctattgctttggaaccaatcgtcttgtcctctttatactttgttggtccaaagttgtctgaagaaatcatttgtcacccagaatactacaacttgatgcatttgttgaatatctgtggtagattgttgaacgatatccaaggttgtaaacgtgaagcccaccaaggtaagttgaactccgtcactttgtacatggaagaaaactctggtactaccatggaagatgctatcgtttacttgagaaagaccatcgacgaatccagacaattgctattgaaagaagttttaagaccatctattgttccaagagaatgtaaacaattgcactggaacatgatgagaatcttgcaattgttctacttgaagaacgatggttttacctctccaactgaaatgttgggttacgtcaacgccgtcattgtcgacccaattttg

SEQ ID NO: 97 - DNA, 900 bp, Artificial Sequence
  Q45222, Bradyrhizobium japonicum
atgatccaaactgaaagagctgtccaacaagttttggaatggggtcgttctttgaccggtttcgctgacgaacacgctgtcgaagctgttcgtggtggtcaatacatcttacaaagaatccacccatctttgagaggtacttctgccagaactggtagagatccacaagatgaaactttgattgtcaccttttacagagaattggctttgttgttctggttagatgactgtaacgatttgggtttgatttccccagaacaattggctgctgtcgaacaagctttgggtcaaggtgtcccatgtgctttgccaggtttcgaaggttgtgccgttttgagagcttctttggccactttggcctacgacagaagagactacgctcaattgttggatgacaccagatgttactccgctgctttgagagctggtcatgcccaagctgttgctgctgaaagatggtcctacgctgaatacttgcacaacggtattgactccattgcttacgctaacgttttctgttgtttgtccctattatggggtttggacatggctactttgagagccagaccagctttcagacaagtcttgagattaatctctgccattggtagattacaaaacgatttgcacggttgtgacaaggaccgttctgctggtgaagctgacaacgctgtcatcttattgttgcaaagatacccagccatgccagttgttgaattcttgaacgatgaattggctggtcacaccagaatgttgcaccgtgtcatggctgaagaaagattcccagctccatggggtccattaatcgaagctatggctgccatcagagttcaatactacagaacctccacctctcgttacagatctgacgctgttagaggtggtcaaagagcccctgcc

SEQ ID NO: 98 - DNA, 2838 bp, Artificial Sequence; identical to SEQ ID NO: 73
  O13284, Phaeosphaeria sp

SEQ ID NO: 99 - DNA, 2856 bp, Artificial Sequence; identical to SEQ ID NO: 74
  Q9UVY5, Gibberella fujikuroi

SEQ ID NO: 100 - DNA, 2352 bp, Artificial Sequence
  Q9XEI0, Stevia rebaudiana
atgaacttgtctctatgtattgcttctccattattgaccaaatctaacagaccagccgctctatccgctattcacactgcctccacttctcacggtggtcaaaccaacccaaccaacttgattattgacaccaccaaggaaagaatccaaaagcaattcaagaatgttgaaatctccgtttcctcctacgacactgcttgggttgccatggttccatctccaaactccccaaagtctccatgtttcccagaatgtttgaactggttaatcaacaaccaattgaacgatggttcctggggtttagtcaatcacacccacaaccacaatcacccattgttgaaggactctctatcctccactttggcttgtatcgttgctttgaagagatggaacgttggtgaagaccaaatcaacaagggtttgtcctttattgaatccaacttggcttctgctactgaaaagtcccaaccatctcctatcggttttgacatcattttcccaggtttattggaatacgctaagaacttggacatcaacttattatctaagcaaaccgatttctccttgatgttgcacaagagagaattggaacaaaagagatgtcactccaacgaaatggacggttacttggcttacatttctgaaggtttgggtaacttgtacgactggaacatggtcaagaaataccaaatgaagaacggttccgttttcaactctccatctgctaccgctgctgctttcatcaaccatcaaaacccaggttgtttgaactacttgaactctttgttggacaaattcggtaacgctgttccaactgtctacccacacgatttgtttatcagattatccatggttgacaccattgaacgtttgggtatttctcatcacttcagagtcgaaatcaagaacgttttggatgaaacttacagatgttgggttgaaagagatgaacaaatcttcatggatgtcgtcacttgtgccttggccttcagattattgagaattaacggttacgaagtttctccagacccattggctgaaatcactaacgaattggctttgaaggacgaatacgccgctttggaaacttaccatgcctctcacatcttataccaagaagacttgtcctctggtaagcaaatcttgaagtctgctgacttcttgaaggaaattatctctactgattctaacagattgtccaagttgattcacaaggaagttgaaaacgccttgaaattcccaatcaacactggtttggaaagaattaacaccagaagaaacatccaattatacaacgttgacaacactagaatcttgaagactacttatcactcttccaacatctccaacactgactacttgagattggctgtcgaagatttctacacctgtcaatctatttacagagaagaattgaagggtttggaaagatgggttgtcgaaaacaaattggaccaattgaaatttgctagacaaaagaccgcctactgttacttctccgttgctgccactttgtcctctccagaattatctgacgccagaatctcctgggctaagaatggtatcttgaccaccgttgtcgatgacttcttcgatattggtggtaccattgacgaattgaccaacttgattcaatgtgttgaaaagtggaacgtcgatgtcgataaggactgttgttctgaacacgtcagaatcttattcttggctttgaaagatgctatctgttggatcggtgacgaagctttcaaatggcaagctcgtgacgttacctctcacgtcatccaaacctggttggaattgatgaactctatgttgagagaagccatctggacccgtgatgcttacgtcccaactttgaacgaatacatggaaaatgcttacgtttctttcgctttgggtccaattgtcaagcctgctatttacttcgttggtccaaagttgtccgaagaaattgttgaatcttctgaataccacaacttgttcaaattgatgtctactcaaggtcgtttgttgaacgatatccactctttcaagcgtgaattcaaggaaggtaagttgaatgctgttgctttgcatttgtctaacggtgaatctggtaaggtcgaagaagaagttgtcgaagaaatgatgatgatgatcaagaacaagagaaaggaattgatgaagttgatctttgaagaaaacggttctattgtcccaagagcttgtaaggatgctttctggaacatgtgtcacgtcttgaacttcttctacgctaacgatgacggtttcactggtaacaccatcttagacaccgtcaaggacatcatttacaacccattagtcttggttaacgaaaacgaagaacaaaga

SEQ ID NO: 101 - DNA, 2271 bp, Artificial Sequence
  Q9XEI0, Stevia rebaudiana
atgacttctcacggtggtcaaaccaacccaaccaacttgattattgacaccaccaaggaaagaatccaaaagcaattcaagaatgttgaaatctccgtttcctcctacgacactgcttgggttgccatggttccatctccaaactccccaaagtctccatgtttcccagaatgtttgaactggttaatcaacaaccaattgaacgatggttcctggggtttagtcaatcacacccacaaccacaatcacccattgttgaaggactctctatcctccactttggcttgtatcgttgctttgaagagatggaacgttggtgaagaccaaatcaacaagggtttgtcctttattgaatccaacttggcttctgctactgaaaagtcccaaccatctcctatcggttttgacatcattttcccaggtttattggaatacgctaagaacttggacatcaacttattatctaagcaaaccgatttctccttgatgttgcacaagagagaattggaacaaaagagatgtcactccaacgaaatggacggttacttggcttacatttctgaaggtttgggtaacttgtacgactggaacatggtcaagaaataccaaatgaagaacggttccgttttcaactctccatctgctaccgctgctgctttcatcaaccatcaaaacccaggttgtttgaactacttgaactctttgttggacaaattcggtaacgctgttccaactgtctacccacacgatttgtttatcagattatccatggttgacaccattgaacgtttgggtatttctcatcacttcagagtcgaaatcaagaacgttttggatgaaacttacagatgttgggttgaaagagatgaacaaatcttcatggatgtcgtcacttgtgccttggccttcagattattgagaattaacggttacgaagtttctccagacccattggctgaaatcactaacgaattggctttgaaggacgaatacgccgctttggaaacttaccatgcctctcacatcttataccaagaagacttgtcctctggtaagcaaatcttgaagtctgctgacttcttgaaggaaattatctctactgattctaacagattgtccaagttgattcacaaggaagttgaaaacgccttgaaattcccaatcaacactggtttggaaagaattaacaccagaagaaacatccaattatacaacgttgacaacactagaatcttgaagactacttatcactcttccaacatctccaacactgactacttgagattggctgtcgaagatttctacacctgtcaatctatttacagagaagaattgaagggtttggaaagatgggttgtcgaaaacaaattggaccaattgaaatttgctagacaaaagaccgcctactgttacttctccgttgctgccactttgtcctctccagaattatctgacgccagaatctcctgggctaagaatggtatcttgaccaccgttgtcgatgacttcttcgatattggtggtaccattgacgaattgaccaacttgattcaatgtgttgaaaagtggaacgtcgatgtcgataaggactgttgttctgaacacgtcagaatcttattcttggctttgaaagatgctatctgttggatcggtgacgaagctttcaaatggcaagctcgtgacgttacctctcacgtcatccaaacctggttggaattgatgaactctatgttgagagaagccatctggacccgtgatgcttacgtcccaactttgaacgaatacatggaaaatgcttacgtttctttcgctttgggtccaattgtcaagcctgctatttacttcgttggtccaaagttgtccgaagaaattgttgaatcttctgaataccacaacttgttcaaattgatgtctactcaaggtcgtttgttgaacgatatccactctttcaagcgtgaattcaaggaaggtaagttgaatgctgttgctttgcatttgtctaacggtgaatctggtaaggtcgaagaagaagttgtcgaagaaatgatgatgatgatcaagaacaagagaaaggaattgatgaagttgatctttgaagaaaacggttctattgtcccaagagcttgtaaggatgctttctggaacatgtgtcacgtcttgaacttcttctacgctaacgatgacggtttcactggtaacaccatcttagacaccgtcaaggacatcatttacaacccattagtcttggttaacgaaaacgaagaacaaaga

SEQ ID NO: 102 - DNA, 2352 bp, Artificial Sequence
  Q9XEI0, Stevia rebaudiana
atgaacctgtctctctgtatcgcctctcctctcctcaccaagtccaaccgacccgctgctctgtctgccatccacaccgcctccacctcccacggcggccagaccaaccccaccaacctcatcattgacaccaccaaggagcgaatccagaagcagttcaagaacgtcgagatctccgtttcctcctacgacaccgcctgggtcgccatggtcccctctcccaactcccccaagtctccctgcttccccgagtgtctcaactggctcatcaacaaccagctcaacgacggctcttggggtctggtcaaccacacccacaaccacaaccaccccctcctcaaggactctctctcttccactctcgcctgcattgttgctctcaagcgatggaacgttggcgaggaccagatcaacaagggtctgtctttcattgagtccaacctcgcctccgccaccgagaagtcccagccctcccccattggctttgatatcatcttccccggtctgctcgagtacgccaagaacctcgatatcaacctgctctccaagcagaccgacttctctctcatgctgcacaagcgagagctcgagcagaagcgatgccactccaacgagatggacggctacctggcctacatttccgagggtctgggtaacctctacgactggaacatggtcaagaagtaccagatgaagaacggttccgttttcaactccccctctgccaccgctgctgccttcatcaaccaccagaaccccggctgtctcaactacctcaactctctgctcgacaagtttggtaacgccgtccccactgtctacccccacgatctcttcatccgactctccatggtcgacaccattgagcgactcggtatttcccaccacttccgagtcgagatcaagaacgttctcgatgagacttaccgatgctgggttgagcgagatgagcagatcttcatggacgttgtcacctgtgctctggccttccgactcctccgaatcaacggttacgaggtttcccccgaccccctcgccgagatcaccaacgagctggctctcaaggacgagtacgccgccctcgagacttaccacgcttctcacattctgtaccaagaggatctgtcctccggcaagcagattctcaagtccgccgacttcctcaaggagatcatctccactgactccaaccgactctccaagctcatccacaaggaagtcgagaacgctctcaagttccccatcaacaccggtctggagcgaatcaacacccgacgaaacatccagctctacaacgtcgacaacacccgaattctcaagaccacctaccactcttccaacatctccaacaccgactacctgcgactcgccgtcgaggacttctacacctgccagtccatctaccgagaggagctcaagggtctggagcgatgggttgtcgagaacaagctcgaccagctcaagtttgcccgacaaaagactgcctactgctacttctccgttgctgccaccctctcttctcccgagctctccgacgcccgaatctcttgggccaagaacggtatcctgaccactgttgtcgacgacttctttgacattggtggcaccattgacgagctgaccaacctcatccagtgcgtcgagaagtggaacgtcgacgttgacaaggactgttgttccgagcacgtccgaatcctcttcctggctctcaaggacgccatctgctggatcggtgacgaggccttcaagtggcaggctcgagatgtcacttcccacgtcatccagacctggctcgagctcatgaactccatgctgcgagaggccatctggacccgagatgcctacgtccccaccctcaacgagtacatggagaacgcctacgtcagctttgctctcggtcccattgtcaagcccgccatctactttgtcggtcccaagctgtccgaggagattgtcgagtcctccgagtaccacaacctcttcaagctcatgtccacccagggccgactcctcaacgatatccactccttcaagcgagagttcaaggaaggtaagctcaacgccgttgctctgcacctgtccaacggtgagtccggcaaggtcgaggaagaggtcgtcgaggagatgatgatgatgatcaagaacaagcgaaaggagctcatgaagctcatcttcgaggagaacggctccattgtcccccgagcctgcaaggacgccttctggaacatgtgccacgtcctcaacttcttctacgccaacgacgacggtttcaccggcaacaccattctcgacaccgtcaaggacatcatctacaaccctctggttctggtcaacgagaacgaggagcagagg

SEQ ID NO: 103 - DNA, 2271 bp, Artificial Sequence
  Q9XEI0, Stevia rebaudiana
atgacctcccacggcggccagaccaaccccaccaacctcatcattgacaccaccaaggagcgaatccagaagcagttcaagaacgtcgagatctccgtttcctcctacgacaccgcctgggtcgccatggtcccctctcccaactcccccaagtctccctgcttccccgagtgtctcaactggctcatcaacaaccagctcaacgacggctcttggggtctggtcaaccacacccacaaccacaaccaccccctcctcaaggactctctctcttccactctcgcctgcattgttgctctcaagcgatggaacgttggcgaggaccagatcaacaagggtctgtctttcattgagtccaacctcgcctccgccaccgagaagtcccagccctcccccattggctttgatatcatcttccccggtctgctcgagtacgccaagaacctcgatatcaacctgctctccaagcagaccgacttctctctcatgctgcacaagcgagagctcgagcagaagcgatgccactccaacgagatggacggctacctggcctacatttccgagggtctgggtaacctctacgactggaacatggtcaagaagtaccagatgaagaacggttccgttttcaactccccctctgccaccgctgctgccttcatcaaccaccagaaccccggctgtctcaactacctcaactctctgctcgacaagtttggtaacgccgtccccactgtctacccccacgatctcttcatccgactctccatggtcgacaccattgagcgactcggtatttcccaccacttccgagtcgagatcaagaacgttctcgatgagacttaccgatgctgggttgagcgagatgagcagatcttcatggacgttgtcacctgtgctctggccttccgactcctccgaatcaacggttacgaggtttcccccgaccccctcgccgagatcaccaacgagctggctctcaaggacgagtacgccgccctcgagacttaccacgcttctcacattctgtaccaagaggatctgtcctccggcaagcagattctcaagtccgccgacttcctcaaggagatcatctccactgactccaaccgactctccaagctcatccacaaggaagtcgagaacgctctcaagttccccatcaacaccggtctggagcgaatcaacacccgacgaaacatccagctctacaacgtcgacaacacccgaattctcaagaccacctaccactcttccaacatctccaacaccgactacctgcgactcgccgtcgaggacttctacacctgccagtccatctaccgagaggagctcaagggtctggagcgatgggttgtcgagaacaagctcgaccagctcaagtttgcccgacaaaagactgcctactgctacttctccgttgctgccaccctctcttctcccgagctctccgacgcccgaatctcttgggccaagaacggtatcctgaccactgttgtcgacgacttctttgacattggtggcaccattgacgagctgaccaacctcatccagtgcgtcgagaagtggaacgtcgacgttgacaaggactgttgttccgagcacgtccgaatcctcttcctggctctcaaggacgccatctgctggatcggtgacgaggccttcaagtggcaggctcgagatgtcacttcccacgtcatccagacctggctcgagctcatgaactccatgctgcgagaggccatctggacccgagatgcctacgtccccaccctcaacgagtacatggagaacgcctacgtcagctttgctctcggtcccattgtcaagcccgccatctactttgtcggtcccaagctgtccgaggagattgtcgagtcctccgagtaccacaacctcttcaagctcatgtccacccagggccgactcctcaacgatatccactccttcaagcgagagttcaaggaaggtaagctcaacgccgttgctctgcacctgtccaacggtgagtccggcaaggtcgaggaagaggtcgtcgaggagatgatgatgatgatcaagaacaagcgaaaggagctcatgaagctcatcttcgaggagaacggctccattgtcccccgagcctgcaaggacgccttctggaacatgtgccacgtcctcaacttcttctacgccaacgacgacggtttcaccggcaacaccattctcgacaccgtcaaggacatcatctacaaccctctggttctggtcaacgagaacgaggagcagagg

SEQ ID NO: 104 - DNA, 2364 bp, Artificial Sequence
  Q9FXV8, Lactuca sativa (Garden Lettuce)
atgaacattgcccagatcacctcttctgccatgctcgtcccctcttcccacattccccaccgatcttgggtcgtcaactgctgcatggtccagtacaacccctccggtctgcgaaccgcttcttcccaggctggccaggtcaaccccactgtcatgaccctcgatgtcaccaaggagcgaatccgaaagctcttcaacaacgttgaggtttccgtttcctcttacgacaccgcctgggttgccatggtcccctctcccaactcccccaagtctccttgtttccccgactgtctcaactggctcctcgacaaccagctcgacgacggctcttggggtctgctcccccaccagtctcctctgatcaaggacaccctctcttccactctggcctgtgtccttgctctcaagcgatggaacgtcggtaaggaccagatcaacaagggtctgcactacattgagtccaactttgcctccgtcaccgacaagaaccaggcttctccctttggcttcgacatcatcttccccggtatgctcgagtacgccaaggacctcgatatcaagctgcccctcaaccagacccacctgtccgtcatgctccacgagcgagagctcgagctccgacgatgccactccaacggccgagaggcctacctcgcctacatctccgagggtcttggtaacctcaacgactggaacatggtcatgaagtaccagatgaagaacggctctctgttcaactccccctctgccaccgcctccgttctcatccaccaccagaacgccggctgtctgcactacctgacctctctgctcgacaagtttggtaacgctgtccccaccgtctaccccattgatctgtacgtccgactctccatggtcgacaccctcgagcgactcggtatcaagcgacacttcatggtcgagatccagaacgttctcgacgagacttaccgatgctgggtccagggtgatgtccagatcttcatggacgttgtcacctgtgctctggccttccgagttctgcgatccaacggttacgaggtttcttccgaccctctggccaagatcaccaaggaaggtgactacatgaactcccccgagaagcccttcaaggacgtctacacctctctcgaggtctacaaggcctcccagatcatctaccaagaggagctcgccttccgagagcagaacctgacctcctacctgccctcttccaacaagctctccaactacattctcaaagaggtcgacgacgctctcaagttccccttcaacggctctctcgagcgaatgtccacccgacgaaacattgagcactacaacctcaaccacacccgaattctcaagaccacctactcctcttccaacatctccaacaaggactacctcaagctcgccgtccaggacttcaacgagtgccagtccatctactgtgaggagctcaaggacctcgagcgatgggttgtcgagaaccgactcgacaagctcaagtttgcccgacaaaagactgcttactgctacttctccgctgcctctttcctctcctcccccgatctgtccgacgcccgaatctcttgggccaagtcctccattctgaccaccgtcattgacgacttcttcgatgtcggtggctccatggacgagctcgtcaactttgtccacatcattgagaagtggaacgtcaacgtcgagaacgactgctgctccgaagaggtcggtgttctcttcctggctctcaaggacgccgtctgctggatcggtgacaaggccttcaagatccaggagcgaaacatcacctcccacgtcattgagatctggctcgatctcgtcaagtccatgctgcgagaggccatctgggccaaggacggctccatccccaccatcaacgagtacatggagaacggctacgtttcctttgctctcggtcccattgttctgcccactctctacttcctcggtgtcaagctgtccgaggaagttgtccagtcctccgagtaccacaagctctacgaggtcatgtccacccagggccgactcatgaacgacatccactccttcaagcgagagaagaaggctggtaagctcaacgccgtcgccctctacatgtccgacggcaagtccggctccgtcgaagaggaagttgtcgaggagatgaagatcctcaccaagtcccagcgaaaggagatgatgaagctcgttctcgagactaagggctccgtcgtcccccgagtctgcaaggatgttttctggaacatgtgcaacgttctcaacctcttctacgccaccgacgacggtttcactggtaacgccattctcgatgttgtcaaggagatcatctacgagcccgtttcccacgagctcatc

SEQ ID NO: 105 - DNA, 2250 bp, Artificial Sequence
  Q9FXV8, Lactuca sativa (Garden Lettuce)
atggcttcttcccaggctggccaggtcaaccccactgtcatgaccctcgatgtcaccaaggagcgaatccgaaagctcttcaacaacgttgaggtttccgtttcctcttacgacaccgcctgggttgccatggtcccctctcccaactcccccaagtctccttgtttccccgactgtctcaactggctcctcgacaaccagctcgacgacggctcttggggtctgctcccccaccagtctcctctgatcaaggacaccctctcttccactctggcctgtgtccttgctctcaagcgatggaacgtcggtaaggaccagatcaacaagggtctgcactacattgagtccaactttgcctccgtcaccgacaagaaccaggcttctccctttggcttcgacatcatcttccccggtatgctcgagtacgccaaggacctcgatatcaagctgcccctcaaccagacccacctgtccgtcatgctccacgagcgagagctcgagctccgacgatgccactccaacggccgagaggcctacctcgcctacatctccgagggtcttggtaacctcaacgactggaacatggtcatgaagtaccagatgaagaacggctctctgttcaactccccctctgccaccgcctccgttctcatccaccaccagaacgccggctgtctgcactacctgacctctctgctcgacaagtttggtaacgctgtccccaccgtctaccccattgatctgtacgtccgactctccatggtcgacaccctcgagcgactcggtatcaagcgacacttcatggtcgagatccagaacgttctcgacgagacttaccgatgctgggtccagggtgatgtccagatcttcatggacgttgtcacctgtgctctggccttccgagttctgcgatccaacggttacgaggtttcttccgaccctctggccaagatcaccaaggaaggtgactacatgaactcccccgagaagcccttcaaggacgtctacacctctctcgaggtctacaaggcctcccagatcatctaccaagaggagctcgccttccgagagcagaacctgacctcctacctgccctcttccaacaagctctccaactacattctcaaagaggtcgacgacgctctcaagttccccttcaacggctctctcgagcgaatgtccacccgacgaaacattgagcactacaacctcaaccacacccgaattctcaagaccacctactcctcttccaacatctccaacaaggactacctcaagctcgccgtccaggacttcaacgagtgccagtccatctactgtgaggagctcaaggacctcgagcgatgggttgtcgagaaccgactcgacaagctcaagtttgcccgacaaaagactgcttactgctacttctccgctgcctctttcctctcctcccccgatctgtccgacgcccgaatctcttgggccaagtcctccattctgaccaccgtcattgacgacttcttcgatgtcggtggctccatggacgagctcgtcaactttgtccacatcattgagaagtggaacgtcaacgtcgagaacgactgctgctccgaagaggtcggtgttctcttcctggctctcaaggacgccgtctgctggatcggtgacaaggccttcaagatccaggagcgaaacatcacctcccacgtcattgagatctggctcgatctcgtcaagtccatgctgcgagaggccatctgggccaaggacggctccatccccaccatcaacgagtacatggagaacggctacgtttcctttgctctcggtcccattgttctgcccactctctacttcctcggtgtcaagctgtccgaggaagttgtccagtcctccgagtaccacaagctctacgaggtcatgtccacccagggccgactcatgaacgacatccactccttcaagcgagagaagaaggctggtaagctcaacgccgtcgccctctacatgtccgacggcaagtccggctccgtcgaagaggaagttgtcgaggagatgaagatcctcaccaagtcccagcgaaaggagatgatgaagctcgttctcgagactaagggctccgtcgtcccccgagtctgcaaggatgttttctggaacatgtgcaacgttctcaacctcttctacgccaccgacgacggtttcactggtaacgccattctcgatgttgtcaaggagatcatctacgagcccgtttcccacgagctcatc

SEQ ID NO: 106 - DNA, 2271 bp, Artificial Sequence
  D2X8G1, Picea glauca
atgaagcgagagcagtacaccatcctcaacgagaaggagtccatggccgaggagctcatcctccgaatcaagcgaatgttctccgagattgagaacacccagacctccgcctccgcctacgacaccgcctgggttgccatggtcccctctctcgactcctcccagcagccccagttcccccagtgcctctcttggatcatcgacaaccagctcctcgacggctcttggggtatcccctacctcatcatcaaggaccgactctgccacaccctcgcctgtgtcattgctctgcgaaagtggaacgccggtaaccagaacgtcgagactggtctgcgattcctgcgagagaacattgagggtattgtccacgaggacgagtacacccccattggtttccagatcatcttccccgccatgctcgaggaagctcgaggtctgggtctggagctcccctacgatctgacccccatcaagctcatgctgacccaccgagagaagatcatgaagggcaaggccattgaccacatgcacgagtacgactcctctctcatctacaccgtcgagggtatccacaagattgtcgactggaacaaggttctcaagcaccagaacaaggacggctctctcttcaactccccctctgccaccgcctgtgctctcatgcacacccgaaagtccaactgtctggagtacctctcttccatgctccagaagctcggtaacggtgtcccctccgtctaccccatcaacctctacgcccgaatctccatgattgaccgactccagcgactcggtctggcccgacacttccgaaacgagatcatccacgccctcgacgacatctaccgatactggatgcagaaggagacttctcgagagggcaagtctctcacccccgacattgtttccacctccattgccttcatgctgctgcgactccacggctacgatgtccccgctgacgttttctgctgctaccacctccactccattgagcagtccggtgaggctgtcactgccatgctgtctctgtaccgagcctcccagatcatgttccccggtgagactatcctcgaggagatcaagaccgtttcccgaaagtacctcgacaagcgaaaggagaacggtcgaatctactaccacaacattgtcatgaaggacctccgaggtgaggttgagtacgccctctccgtcccctggtacgcctctctcgagcgaatcgagaaccgacgatacattgaccagtacggtgtcaacgacacctggatcgccaagacctcttacaagatcccctgtatctccaacgatctgttcctggctctggccaagcaggactacaacatctgtcaggccatccagcagaaggagctccgagagctcgagcgatggttcgccgacaacaagttctcccacctcaactttgcccgacagaagctcatctactgctacttctccgctgctgccactctcttctctcccgagctctctgctgctcgagttgtctgggccaagaacggtgtcatcaccaccgttgttgacgacttcttcgatgttggtggctcctccgaggagatccactcttttgtcgaggctgtccgagtctgggatgaggctgccaccgacggtctgtccgagaacgtccagatcctcttctccgctctgtacaacaccgttgacgagattgtccagcaggcctttgtctttcagggccgagacatctccatccacctgcgagagatctggtaccgactcgtcaactccatgatgaccgaggcccagtgggcccgaacccactgcatcccctccatgcacgagtacatggagaacgccgagccttccattgctctcgagcccattgttctctcctctctctactttgtcggccccaagctgtccgaggagatcatctgccaccccgagtactacaacctcatgcacctgctcaacatctgtggccgactcctcaacgatatccagggctgcaagcgagaggcccaccagggcaagctcaactccgtcactctctacatggaggagaactccggcaccaccatggaggatgccattgtctacctgcgaaagaccatcgacgagtcccgacagctcctcctcaaagaggttctgcgaccttccattgtcccccgagagtgcaagcagctccactggaacatgatgcgaatcctccagctcttctacctcaagaacgacggtttcacctcccccaccgagatgctcggctacgtcaacgccgtcattgtcgaccccatattg

SEQ ID NO: 107 - DNA, 900 bp, Artificial Sequence
  Q45222, Bradyrhizobium japonicum
atgatccagaccgagcgagccgtccagcaggttctcgagtggggtcgatctctgaccggctttgccgacgagcacgccgtcgaggccgtccgaggtggtcagtacatcctccagcgaatccacccctctctgcgaggtacctccgcccgaaccggccgagatccccaggacgagactctcattgtcaccttctaccgagagctcgctctgctcttctggctcgacgactgcaacgatctcggcctcatctcccccgagcagctcgccgccgtcgagcaggctctcggccagggtgtcccctgtgctctgcccggtttcgagggctgtgccgtcctccgagcttctctcgccaccctcgcctacgaccgacgagactacgcccagctcctcgacgacacccgatgctactccgctgctctgcgagctggtcacgcccaggctgttgctgccgagcgatggtcctacgccgagtacctccacaacggtatcgactccattgcctacgccaacgttttctgctgtctgtctctgctctggggcctcgacatggccactctgcgagcccgacccgccttccgacaggttctgcgactcatctccgccatcggtcgactccagaacgatctccacggctgcgacaaggaccgatccgccggtgaggctgacaacgccgtcattctgctcctccagcgataccccgccatgcccgttgtcgagttcctcaacgacgagctcgccggccacacccgaatgctgcaccgagtcatggccgaggagcgattccccgctccctggggtcctctcattgaggccatggctgccatccgagtccagtactaccgaacctccacctcccgataccgatccgatgccgtccgaggtggtcagcgagctcccgcc

SEQ ID NO: 108 - DNA, 2838 bp, Artificial Sequence; identical to SEQ ID NO: 83
  O13284, Phaeosphaeria sp

SEQ ID NO: 109 - DNA, 2856 bp, Artificial Sequence; identical to SEQ ID NO: 84
  Q9UVY5, Gibberella fujikuroi

SEQ ID NO: 110 - DNA, 2979 bp, Artificial Sequence; identical to SEQ ID NO: 85
  Synthetic construct

SEQ ID NO: 111 - protein, 511 aa, Artificial Sequence
  B5MEX5, Lactuca sativa (Garden Lettuce)
MDLQTMAPMGSAAIAIGGPAVAVAGGISLLFLKSFLSQQPGNPNHLPSVPAVPGVPLLGNLLELKEKKPYKTFTKWAETYGPIYSIKTGATSMVVVNSNQLAKEAMVTRFDSISTRKLSKALQILTADKTMVAMSDYDDYHKTVKRNLLTSILGPAAQKRHRAHRDAMGDNLSRQLHALALNSPQEAINFRQIFQSELFTLAFKQTFGRDIESIFVGDLGTTMTREEMFQILVVDPMMGAIDVDWRDFFPYLKWIPNAKLEEKIEQMYIRRKAVMKAVIQEHRKRIDSGENLDSYIDFLLAEAQPLTEKQLLMSLWEPIIETSDTTMVTTEWAMYELSKHPNKQQRLYNEIRNICGSEKITEEKLCKMPYLSAVFHETLRVHSPVSIIPLRYVHENTELGGYHVPAGTELAVNIYGCNMEREIWENPEEWSPERFLAENEPVNLQKTMAFGAGKRVCAGAMQAMLLACVGIGRMVQEFEWRLKDDVEEDVNTLGLTTQRLNPMLAVIKPRN

SEQ ID NO: 112 - protein, 512 aa, Artificial Sequence; identical to SEQ ID NO: 31
  B5MEX6, Lactuca sativa (Garden Lettuce)

SEQ ID NO: 113 - protein, 525 aa, Artificial Sequence
  B5DBY4, Sphaceloma manihoticola
MMDDTTSPYSTYHSVRSIRNQSAWALAPIAVFICYVVLRHNRKSVPAASAGSHSILEPLWLARLRFIRDSRFIIGQGYSKFKDTIFKVTKVGADIIVVAPKYVEEIRRLSRDTGRSVEPFIHDFAGELLGGLNFLESDLQTRVVQQKLTPNLKTIVPVMEDEMHYALVSELDSCLDGSEHWTRVDMIHMLSRIVSRISARIFLGPKYCRNDLWLKTTAEYTENLFLTGTLLRFVPRMLQKWIAPLLPSFRQLQENRQAARKIISEILTDHQPEKHDETSDNGDPYPDILTLMFQAARGKEKDIEDIAQHTLLLSLSSIHTTALTMTQALYDLCAYPQYLDPVKHEIADTLQSEGSWSKAMLDKLHMMDSLLRESQRLSPVFLLTFNRILHTPLTLSNGIHLPKGTRIAAPSDAILNDPSLVPGPQPADTFDPFRYINHSTGDAKKTKTNFQTTSLQNMAFGYGKYACPGRFYVANEIKLVLGHLLMHYEFKFPPGMGRPVNSTVDTDMYPDLGARLLVRKRKMEE

SEQ ID NO: 114 - protein, 513 aa, Artificial Sequence
  Q4VCL5, Stevia rebaudiana
MDAVTGLLTVPATAITIGGTAVALAVALIFWYLKSYTSARRSQSNHLPRVPEVPGVPLLGNLLQLKEKKPYMTFTRWAATYGPIYSIKTGATSMVVVSSNEIAKEALVTRFQSISTRNLSKALKVLTADKTMVAMSDYDDYHKTVKRHILTAVLGPNAQKKHRIHRDIMMDNISTQLHEFVKNNPEQEEVDLRKIFQSELFGLAMRQALGKDVESLYVEDLKITMNRDEIFQVLVVDPMMGAIDVDWRDFFPYLKWVPNKKFENTIQQMYIRREAVMKSLIKENKKRIASGEKLNSYIDYLLSEAQTLTDQQLLMSLWEPIIESSDTTMVTTEWAMYELAKNPKLQDRLYRDIKSVCGSEKITEEHLSQLPYITAIFHETLRRHSPVPIIPLRHVHEDTVLGGYHVPAGTELAVNIYGCNMDKNVWENPEEWNPERFMKENETIDFQKTMAFGGGKRVCAGSLQALLTASIGIGRMVQEFEWKLKDMTQEEVNTIGLTTQMLRPLRAIIKPRI

SEQ ID NO: 115 - protein, 525 aa, Artificial Sequence
  Synthetic construct
MSKSNSMNSTSHETLFQQLVLGLDRMPLMDVHWLIYVAFGAWLCSYVIHVLSSSSTVKVPVVGYRSVFEPTWLLRLRFVWEGGSIIGQGYNKFKDSIFQVRKLGTDIVIIPPNYIDEVRKLSQDKTRSVEPFINDFAGQYTRGMVFLQSDLQNRVIQQRLTPKLVSLTKVMKEELDYALTKEMPDMKNDEWVEVDISSIMVRLISRISARVFLGPEHCRNQEWLTTTAEYSESLFITGFILRVVPHILRPFIAPLLPSYRTLLRNVSSGRRVIGDIIRSQQGDGNEDILSWMRDAATGEEKQIDNIAQRMLILSLASIHTTAMTMTHAMYDLCACPEYIEPLRDEVKSVVGASGWDKTALNRFHKLDSFLKESQRFNPVFLLTFNRIYHQSMTLSDGTNIPSGTRIAVPSHAMLQDSAHVPGPTPPTEFDGFRYSKIRSDSNYAQKYLFSMTDSSNMAFGYGKYACPGRFYASNEMKLTLAILLLQFEFKLPDGKGRPRNITIDSDMIPDPRARLCVRKRSLRDE

SEQ ID NO: 116 - DNA, 1533 bp, Artificial Sequence
  Synthetic construct
atggacttgcaaaccatggccccaatgggttctgctgctatcgccatcggtggtccagctgtcgccgttgctggtggtatctccttgttgttcttgaaatccttcttgtctcaacaaccaggtaacccaaaccacttgccatctgtcccagctgtcccaggtgttcctctattaggtaacttgttggaattgaaggaaaagaagccatacaagacctttaccaaatgggctgaaacttacggtccaatctactccatcaagaccggtgctacctccatggttgtcgttaactccaaccaattggccaaggaagctatggtcaccagattcgactccatctctaccagaaagttgtccaaggctttgcaaattttgactgctgacaagaccatggttgccatgtctgactacgatgactaccataaaactgtcaagagaaacttgttgacttctattttgggtccagctgctcaaaagagacacagagcccaccgtgacgctatgggtgacaacttgtccagacaattgcacgctttagctttgaactctcctcaagaagccattaacttcagacaaatcttccaatctgaattattcactttagctttcaagcaaactttcggtagagatatcgaatctatcttcgtcggtgatttgggtactaccatgaccagagaagaaatgttccaaattttggttgttgacccaatgatgggtgctattgacgttgactggagagacttcttcccatacttgaaatggattccaaacgccaaattggaagaaaagatcgaacaaatgtacatcagaagaaaggctgttatgaaggctgttatccaagaacacagaaagagaattgattctggtgaaaacttggattcttacattgatttcttgttggctgaagctcaaccattgactgaaaagcaattattgatgtccttgtgggaaccaattattgaaacttctgacaccaccatggttaccactgaatgggctatgtacgaattgtctaagcacccaaacaagcaacaaagattatacaatgaaatcagaaacatctgtggttctgaaaagatcactgaagaaaagttgtgtaagatgccatacttatctgctgtctttcacgaaactttacgtgttcactctccagtttccatcattccattacgttacgttcacgaaaacactgaattgggtggttaccatgtcccagctggtactgaattggctgtcaacatctacggttgtaacatggaaagagaaatctgggaaaacccagaagaatggtccccagaaagattcttggctgaaaacgaaccagttaacttgcaaaagaccatggcctttggtgctggtaagagagtctgtgccggtgctatgcaagctatgttgttggcttgtgtcggtattggtagaatggttcaagaattcgaatggagattgaaagatgacgtcgaagaagatgtcaacactttaggtttgaccactcaaagattgaacccaatgttggctgttatcaagcctaggaat

SEQ ID NO: 117 - DNA, 1536 bp, Artificial Sequence
  Synthetic construct
atggatggtgtcattgacatgcaaaccattccattgagaaccgccattgccattggtggtactgctgttgctttggttgttgctctatacttctggttcttgagatcttacgcttctccatctcaccactctaaccatttgccacctgttccagaagttccaggtgtcccagtcttgggtaacttgttgcaattgaaagaaaagaagccatacatgactttcaccaaatgggctgaaatgtacggtccaatctactctatcagaactggtgctacctccatggttgttgtttcctctaacgaaattgccaaggaagttgttgtcactagattcccatccatctccaccagaaagttgtcttacgctttgaaggtcttgactgaagataagtccatggttgctatgtctgattaccatgactaccacaagaccgtcaaaagacacattttgactgctgtcttaggtccaaacgcccaaaagaagttccgtgctcacagagacaccatgatggaaaacgtttccaatgaattgcatgccttctttgaaaagaacccaaaccaagaagtcaacttgagaaagatcttccaatctcaattgttcggtttggccatgaagcaagctttgggtaaggatgtcgaatctatctacgtcaaggacttggaaactaccatgaagagagaagaaatctttgaagtcttggttgttgacccaatgatgggtgccattgaagtcgattggagagacttcttcccatacttgaaatgggttccaaacaaatctttcgaaaacatcattcacagaatgtacacccgtcgtgaagctgtcatgaaggctttgatccaagaacacaagaagagaattgcttctggtgaaaacttaaactcctacattgactacttgttgtctgaagctcaaactttgactgacaagcaattgttgatgtccctatgggaaccaatcattgaatcttccgacaccaccatggtcaccactgaatgggctatgtacgaattggctaagaatccaaacatgcaagacagattgtacgaagaaatccaatctgtttgtggttccgaaaagatcactgaagaaaacttgtctcaattaccatacttgtacgctgttttccaagaaactttgagaaagcactgtccagttccaatcatgccattgagatacgtccacgaaaacaccgttttgggtggttaccacgttccagctggtactgaagttgctatcaacatctatggttgtaacatggacaagaaggtctgggaaaacccagaagaatggaacccagaaagattcttatccgaaaaggaatccatggacttgtacaagaccatggccttcggtggtggtaagagagtttgtgctggttctttgcaagctatggtcatctcttgtatcggtattggtagattagtccaagattttgaatggaaattgaaagatgacgctgaagaagatgtcaacactttaggtttaaccactcaaaagttgcacccattattggctttgatcaaccctcgaaag

SEQ ID NO: 118 - DNA, 1575 bp, Artificial Sequence
  Synthetic construct
atgatggacgacaccacttctccatactccacttaccactctgtcagatccattagaaaccaatctgcttgggctttggctccaattgctgtctttatttgttacgttgtcttgagacacaacagaaagtctgtcccagctgcctccgctggttctcactccatcttggaaccattatggttagctagattacgtttcatcagagactccagattcatcatcggtcaaggttactccaagttcaaggatactatcttcaaggttaccaaggtcggtgctgacatcatcgttgttgctccaaagtacgtcgaagaaatcagaagattgtctcgtgacaccggtagatctgttgaaccattcatccacgatttcgctggtgaattgttgggtggtttgaatttcttggaatctgatttgcaaaccagagttgtccaacaaaagttgaccccaaacttgaaaactattgtcccagtcatggaagatgaaatgcattacgctttggtttctgaattggattcttgtttggacggttccgaacactggaccagagttgacatgattcacatgttgtccagaatcgtttccagaatttctgccagaatcttcttgggtccaaagtactgtagaaacgacttatggttaaagaccaccgctgaatacactgaaaacttgttcttgaccggtactctattgagatttgtcccaagaatgttgcaaaagtggatcgctccattactaccatctttccgtcaattgcaagaaaacagacaagctgccagaaagatcatttctgaaattttgactgaccatcaaccagaaaagcacgatgaaacctctgacaacggtgacccatacccagatatcttgactttgatgttccaagctgcccgtggtaaggaaaaggacatcgaagatatcgctcaacacactttgttgctatctttgtcctccattcacactaccgctttgaccatgactcaagctttgtacgacttgtgtgcctacccacaatacttggaccctgttaagcacgaaattgctgacaccttgcaatctgaaggttcctggtctaaggctatgttggacaaattgcacatgatggactctttgttgagagaatctcaaagattatctcctgttttcttattgactttcaacagaattttgcacaccccattgactttgtccaacggtatccatttgccaaagggtactagaattgctgctccttctgatgccattttgaacgatccatctttagtcccaggtccacaaccagctgacactttcgacccatttagatacatcaaccactccactggtgatgctaagaaaaccaagaccaacttccaaaccacttctttgcaaaacatggctttcggttacggtaaatacgcttgtccaggtcgtttctatgttgccaacgaaatcaaattggttttaggtcacttgttgatgcactacgaattcaagttcccaccaggtatgggtagaccagttaactccaccgtcgatactgacatgtacccagatttgggtgccagattgttggttagaaagagaaagatggaagaa

SEQ ID NO: 119 - DNA, 1539 bp, Artificial Sequence
  Synthetic construct
atggatgctgtcactggtttgttgaccgtcccagctaccgccatcaccattggtggtactgctgttgctttggctgttgctttgatcttctggtacttgaaatcttacacttctgccagaagatctcaatctaaccatttaccaagagttccagaagttccaggtgttccattgttgggtaacttgttgcaattgaaagaaaagaagccttacatgactttcaccagatgggctgctacctacggtccaatttactctatcaagaccggtgctacctccatggttgttgtttcctccaacgaaattgccaaggaagctttagtcaccagattccaatccatctctaccagaaacttgtccaaggctttgaaggtcttgactgctgacaagaccatggttgccatgtctgactacgatgactaccacaagactgtcaaacgtcacatcttgactgctgttttgggtccaaatgctcaaaagaagcacagaattcacagagatatcatgatggacaacatctctactcaattgcatgaatttgtcaagaacaacccagaacaagaagaagtcgatttgagaaagatcttccaatctgaattgttcggtttggccatgagacaagctttgggtaaagatgtcgaatctttatacgtcgaagatttgaagatcaccatgaacagagatgaaatcttccaagttttggttgtcgacccaatgatgggtgccattgatgttgactggagagatttcttcccatacttgaaatgggttccaaacaagaagttcgaaaataccattcaacaaatgtacatccgtcgtgaagctgtcatgaagtctttaatcaaggaaaacaagaagagaattgcttctggtgaaaagttaaactcctacattgactatttgttgtccgaagctcaaactttgactgaccaacaattattgatgtctttatgggaaccaatcattgaatcttctgacaccaccatggtcactactgaatgggctatgtacgaattggccaagaacccaaaattacaagaccgtttgtacagagatatcaaatccgtctgtggttccgaaaagatcactgaagaacacttgtctcaattgccatacatcactgctatcttccacgaaactttgagaagacactctccagttccaatcattccattgagacacgtccacgaagacactgttttgggtggttaccacgttccagctggtactgaattggctgtcaacatctacggttgtaacatggacaagaacgtctgggaaaacccagaagaatggaacccagaaagattcatgaaggaaaacgaaaccattgacttccaaaagaccatggctttcggtggtggtaagagagtttgtgccggttccttgcaagctctattgaccgcttccattggtattggtagaatggttcaagaatttgaatggaagttgaaggacatgacccaagaagaagttaacaccattggtttgactactcaaatgttaagaccattgagagccatcatcaagcctcgcatc

SEQ ID NO: 120 - DNA, 1575 bp, Artificial Sequence
  Synthetic construct
atgtccaagtctaactccatgaactccacttctcacgaaactttattccaacaattggttttgggtttggacagaatgccattgatggatgtccactggttgatctacgttgctttcggtgcttggttatgttcctacgtcattcacgttttgtcctcttcttctaccgtcaaggttccagttgtcggttacagatccgttttcgaaccaacctggttattgagattaagatttgtctgggaaggtggttccattattggtcaaggttacaacaaattcaaggactctatcttccaagtcagaaagttgggtactgacattgttatcatcccaccaaactacatcgatgaagtcagaaagttgtcccaagacaagaccagatctgttgaaccattcatcaacgatttcgctggtcaatacaccagaggtatggtctttctacaatctgatttgcaaaaccgtgtcatccaacaaagattgactccaaagttggtttctttgactaaggtcatgaaggaagaattggactacgctttgaccaaggaaatgccagacatgaagaacgacgaatgggttgaagttgacatttcttccatcatggtcagattgatctccagaatctctgcccgtgttttcttgggtccagaacactgtcgtaaccaagaatggttgaccaccactgctgaatactctgaatctttattcatcactggtttcatcttgagagttgtcccacacatcttaagaccattcattgctccattgttgccttcttacagaactttgttgagaaatgtctcttctggtagaagagttatcggtgatatcatcagatctcaacaaggtgatggtaacgaagatatcttgtcctggatgagagatgctgctaccggtgaagaaaagcaaattgacaacattgctcaaagaatgttgatcttgtctttggcttccattcacaccaccgccatgaccatgacccatgccatgtacgacttgtgtgcctgtccagaatacattgaaccattacgtgacgaagtcaaatccgttgttggtgcttctggttgggacaagactgctttgaacagattccacaagttggactctttcttgaaggaatctcaaagattcaacccagttttcttgttgactttcaacagaatctaccatcaatccatgactttgtccgatggtaccaacattccatctggtaccagaattgctgttccatctcacgctatgttgcaagattctgctcacgttccaggtccaactcctccaactgaatttgacggtttcagatactccaagatcagatctgactctaactatgctcaaaagtacttgttctccatgaccgattcttccaacatggctttcggttacggtaagtacgcttgtccaggtcgtttctacgcctccaacgaaatgaaattgactttggccattttgttgttgcaatttgaattcaaattgccagatggtaagggtagaccaagaaacatcactatcgactctgacatgattccagacccaagagctagattatgtgtcagaaagagatctctacgtgacgaa

SEQ ID NO: 121 - DNA, 1539 bp, Artificial Sequence
  Synthetic construct
atggacgccgtcactggtctgctcaccgtccccgccactgccatcaccatcggtggtactgccgttgctctggccgttgctctcatcttctggtacctcaagtcctacacctctgcccgacgatcccagtccaaccacctcccccgagtccccgaggtccccggtgtccccctgctcggtaacctgctccagctcaaggagaagaagccctacatgaccttcacccgatgggctgccacctacggccccatctactccatcaagactggtgccacctccatggttgttgtctcttccaacgagattgctaaagaggctctcgtcacccgattccagtccatctccacccgaaacctctccaaggctctcaaggttctgaccgccgacaagaccatggttgccatgtccgactacgacgactaccacaagaccgtcaagcgacacattctcaccgccgttctcggccccaacgcccagaagaagcaccgaatccaccgagacatcatgatggacaacatctccacccagctccacgagtttgtcaagaacaaccccgagcaggaagaggttgatctccgaaagatcttccagtccgagctcttcggtctggccatgcgacaggctctgggcaaggatgtcgagtctctctacgtcgaggatctcaagatcaccatgaaccgagatgagatcttccaggttctggttgtcgaccccatgatgggtgccattgatgtcgactggcgagacttcttcccctacctcaagtgggtccccaacaagaagtttgagaacaccatccagcagatgtacatccgacgagaggctgtcatgaagtctctcatcaaggagaacaagaagcgaattgcctccggtgagaagctcaactcctacattgactacctgctctccgaggcccagaccctcaccgaccagcagctgctcatgtctctgtgggagcccatcattgagtcctccgacaccaccatggtcaccaccgagtgggccatgtacgagctcgccaagaaccccaagctccaggaccgactctaccgagacatcaagtctgtctgtggctccgagaagatcaccgaggagcacctgtcccagctcccctacatcactgccatcttccacgagactctccgacgacactctcccgtccccatcatccctctccgacacgtccacgaggacaccgttctgggtggctaccacgtccccgccggtaccgagctcgctgtcaacatctacggctgcaacatggacaagaacgtctgggagaaccccgaggagtggaaccccgagcgattcatgaaggagaacgagactattgacttccagaaaaccatggcctttggtggtggcaagcgagtctgcgccggctctctccaggctctgctgaccgcctccattggtattggccgaatggtccaggagttcgagtggaagctcaaggacatgacccaggaagaggtcaacaccattggcctcaccacccagatgctccgacctctccgagccatcatcaagccccgaata

SEQ ID NO: 122 - DNA, 1533 bp, Artificial Sequence
  Synthetic construct
atggatctgcagaccatggcccccatgggctctgctgccattgccatcggtggtcccgctgttgccgttgctggtggtatctctctgctcttcctcaagtctttcctgtcccagcagcccggcaaccccaaccacctcccctccgtccccgctgtccccggtgtccctctgctcggtaacctgctcgagctcaaggagaagaagccctacaagaccttcaccaagtgggccgagacttacggccccatctactccatcaagactggtgccacctccatggtcgttgtcaactccaaccagctcgccaaagaggccatggtcacccgattcgactccatctccacccgaaagctctccaaggctctccagattctcactgctgacaagaccatggttgccatgtccgactacgacgactaccacaagaccgtcaagcgaaacctgctcacctccatcctcggtcccgctgcccagaagcgacaccgagcccaccgagatgccatgggtgacaacctgtctcgacagctccacgctcttgctctcaactctcctcaagaggccatcaacttccgacagatcttccagtccgagctcttcactctcgccttcaagcagacctttggccgagacattgagtccatcttcgtcggtgatctcggtaccaccatgacccgagaggagatgttccagatcctcgttgtcgaccccatgatgggtgccattgacgttgactggcgagacttcttcccctacctcaagtggatccccaacgccaagctcgaggagaagattgagcagatgtacatccgacgaaaggccgtcatgaaggccgtcatccaggagcaccgaaagcgaattgactccggcgagaacctcgactcttacattgacttcctgctcgccgaggcccagcctctgaccgagaagcagctcctcatgtctctgtgggagcccatcattgagacttccgacaccaccatggtcaccaccgagtgggccatgtacgagctctccaagcaccccaacaagcagcagcgactctacaacgagatccgaaacatctgtggttccgagaagatcaccgaggagaagctctgcaagatgccctacctgtctgctgttttccacgagactctgcgagtccactcccccgtttccatcatccccctgcgatacgtccacgagaacaccgagctcggcggctaccacgtccccgccggcaccgagctcgccgtcaacatctacggctgcaacatggagcgagagatctgggagaaccccgaggagtggtcccccgagcgattcctcgccgagaacgagcccgtcaacctgcagaaaaccatggcctttggtgctggtaagcgagtctgcgctggtgccatgcaggccatgctgctcgcctgtgtcggtattggccgaatggtccaggagtttgagtggcgactcaaggacgacgttgaagaggatgtcaacaccctcggcctcaccacccagcgactcaaccccatgctcgccgtcatcaagccccggaat

SEQ ID NO: 123 - DNA, 1536 bp, Artificial Sequence
  Synthetic construct
atggacggtgtcattgacatgcagaccatccccctgcgaactgccattgccattggtggtactgctgttgctctcgttgttgctctctacttctggttcctgcgatcttacgcctccccctctcaccactccaaccaccttcctcccgtccccgaggtccccggtgtccccgtcctcggtaacctgctccagctcaaggagaagaagccctacatgaccttcaccaagtgggccgagatgtacggccccatctactccatccgaaccggtgccacctccatggttgttgtctcttccaacgagattgccaaggaagttgttgtcacccgattcccctccatctccacccgaaagctctcttacgctctcaaggtcctcactgaggacaagtccatggttgccatgtccgactaccacgactaccacaagaccgtcaagcgacacattctcaccgccgtcctcggccccaacgcccagaagaagttccgagcccaccgagacaccatgatggagaacgtttccaacgagctccacgccttcttcgagaagaaccccaaccaggaagtcaacctgcgaaagatcttccagtctcagctctttggtctggccatgaagcaggctctcggcaaggatgtcgagtccatctacgtcaaggatctcgagactaccatgaagcgagaggagatcttcgaggttctggtcgtcgaccccatgatgggtgccattgaggtcgactggcgagacttcttcccctacctcaagtgggtccccaacaagtctttcgagaacatcatccaccgaatgtacacccgacgagaggctgtcatgaaggctctcatccaggagcacaagaagcgaattgcctccggtgagaacctcaactcctacattgactacctgctctccgaggcccagaccctcaccgacaagcagctcctcatgtctctgtgggagcccatcatcgagtcctccgacaccaccatggtcaccaccgagtgggccatgtacgagctcgccaagaaccccaacatgcaggaccgactctacgaggagatccagtctgtctgtggctccgagaagatcactgaggagaacctgtcccagctcccctacctctacgccgttttccaggagactctgcgaaagcactgccccgtccccatcatgcccctgcgatacgtccacgagaacaccgtcctcggtggctaccacgtccccgctggtaccgaggttgccatcaacatctacggctgcaacatggacaagaaggtctgggagaaccccgaggagtggaaccccgagcgattcctgtccgagaaggagtccatggacctctacaagaccatggcctttggtggtggcaagcgagtctgtgccggctctctgcaggccatggtcatctcctgcattggtatcggtcgactcgtccaggactttgagtggaagctcaaggacgatgctgaggaagatgtcaacaccctcggcctcaccacccagaagctccaccctctgctcgccctcatcaacccccggaaa

SEQ ID NO: 124 - DNA, 1575 bp, Artificial Sequence
  Synthetic construct
atgatggacgacaccacctccccctactccacctaccactccgtccgatccatccgaaaccagtccgcctgggctctggcccccattgccgtctttatctgctacgttgttctgcgacacaaccgaaagtccgtccccgctgcctctgctggttcccactccatcctcgagcccctgtggctcgcccgactccgattcatccgagactctcgattcatcatcggtcagggctactccaagttcaaggacaccatcttcaaggtcaccaaggtcggtgccgatatcattgttgttgctcccaagtacgtcgaggagatccgacgactctcccgagacaccggccgatccgtcgagcccttcatccacgactttgccggtgagctcctcggtggcctcaacttcctcgagtccgatctccagacccgagttgtccagcagaagctcacccccaacctcaagaccattgtccccgtcatggaggacgagatgcactacgctctcgtttccgagctcgactcttgtctcgatggttccgagcactggacccgagtcgacatgatccacatgctctcccgaattgtctctcgaatctccgcccgaatcttcctcggccccaagtactgccgaaacgatctgtggctcaagaccactgccgagtacaccgagaacctcttcctgaccggtactctgctccgattcgtcccccgaatgctccagaagtggatcgctcctctgctcccctctttccgacagctccaggagaaccgacaggccgcccgaaagatcatctccgagattctgaccgaccaccagcccgagaagcacgacgagacttccgacaacggtgacccctaccccgacattctcaccctcatgttccaggctgcccgaggtaaggagaaggacattgaggacattgcccagcacactctgctcctctctctgtcctccatccacaccactgctctgaccatgacccaggctctctacgatctctgtgcctacccccagtacctcgaccccgtcaagcacgagattgccgacactctgcagtccgagggctcttggtccaaggccatgctcgacaagctccacatgatggactctctgctccgagagtcccagcgactctctcccgtctttctgctcaccttcaaccgaatcctccacacccctctgaccctctccaacggtatccacctccccaagggtacccgaattgccgccccctccgacgccatcctcaacgacccctctctggtccccggcccccagcccgctgacaccttcgaccccttccgatacatcaaccactccaccggtgatgccaagaaaaccaagaccaacttccagaccacctctctgcagaacatggcctttggctacggtaagtacgcctgccccggccgattctacgttgccaacgagatcaagctcgttctcggccacctgctcatgcactacgagttcaagttccctcccggtatgggccgacccgtcaactccactgtcgacaccgacatgtaccccgatctcggtgcccgactcctcgtccgaaagcgaaagatggaggag

SEQ ID NO: 125 - DNA, 1575 bp, Artificial Sequence
  Synthetic construct
atgtccaagtccaactccatgaactccacctcccacgagactctcttccagcagctcgttctcggcctcgaccgaatgcccctcatggacgtccactggctcatctacgttgcctttggtgcctggctctgctcctacgtcatccacgttctgtcctcttcctccactgtcaaggtccccgtcgtcggttaccgatccgttttcgagcccacctggctcctccgactgcgattcgtctgggagggtggttccatcattggccagggctacaacaagttcaaggactccatcttccaggtccgaaagctcggtaccgacattgtcatcatccctcccaactacattgacgaggtccgaaagctctcccaggacaagacccgatccgtcgagcccttcatcaacgactttgccggccagtacacccgaggtatggtctttctgcagtccgatctccagaaccgagtcatccagcagcgactcacccccaagcttgtctctctcaccaaggtcatgaaggaagagctcgactacgctctgaccaaggagatgcccgacatgaagaacgacgagtgggttgaggtcgacatctcttccatcatggtccgactcatctctcgaatctccgcccgagttttcctcggccccgagcactgccgaaaccaggagtggctcaccaccaccgccgagtactccgagtctctcttcatcaccggcttcatcctccgagttgtcccccacattctccgacccttcattgctcctctgctgccctcttaccgaaccctgctgcgaaacgtttcttccggccgacgagtcattggtgatatcatccgatcccagcagggtgacggtaacgaggacatcctctcttggatgcgagatgctgccactggtgaggagaagcagatcgacaacattgcccagcgaatgctcattctgtctctcgcctccatccacaccaccgccatgaccatgacccacgccatgtacgatctgtgtgcctgccccgagtacattgagcccctccgagatgaggtcaagtccgtcgttggtgcttctggctgggacaagaccgctctcaaccgattccacaagctcgactctttcctcaaggagtcccagcgattcaaccccgttttcctgctcaccttcaaccgaatctaccaccagtccatgaccctctccgatggtaccaacatcccctccggtacccgaattgctgtcccctctcacgccatgctccaggactccgcccacgtccccggtcccactcctcccactgagttcgacggtttccgatactccaagatccgatccgactccaactacgcccagaagtacctcttctccatgaccgactcttccaacatggcctttggctacggtaagtacgcctgccccggccgattctacgcctccaacgagatgaagctgactctggccattctgctcctccagtttgagttcaagctccccgacggtaagggccgaccccgaaacatcaccatcgactccgacatgatccccgacccccgagctcgactctgtgtccgaaagcgatctctgcgtgacgag

SEQ ID NO: 126 - protein, 480 aa, Artificial Sequence
  Synthetic construct
MPMTVMLLFVFLLFIAICFFLVHRHNSTTTKNLPPGSFGWPFIGETLAYIRSKRGGDPERFTKERIEKYGSTLVFKTSVAGERMAVFCGPEGNKFLFGNENKLVASWWPNSVRILFEKCLITIRGDEAKWLRKMMFAYLGPDALSNRYTGTMEVVTRLHIQNHWQGKSELKVFETVRPYLFELACRLFLSLDDPKHVAELGTLFNTFLKGLTELPINIPGTRFYRAKRAANAIKKQLIVIIKQRRQALKQEDQSSSFEDLLSHLLVSSDENGRFLSEAEIANNVLLLLFAGHDTSAVSITLLMKSLAEHPQVYDNVLKEQLGILEAKAPGEMLNWEDIQKMRYSWYVVCEVMRLIPPVVGSFREALVDFEYAGYTIPKGWKIIWSAVMTHKEENNFPNATKFDPSRFEGAGPTPFTYVPFGGGPRMCLGKELARVRILVFLHNIMTKFKWDLLIPDEKIGYDPLATPVKGLPVRLHPHQV

SEQ ID NO: 127 - protein, 455 aa, Artificial Sequence
  Synthetic construct
MELVMFPVLALVSTLFLLALHFIIRTLKERLFGSPNLPPGRLGWPLIGETPAFFRAGFEAKPEKFIGERMEKYDSRVFKTSLLGKPFAVISGTAGHKFLFSNENKLVNLWWPESVRMLFKSALVSVVGDEAKRIRKMLMTFLGLDALKNYTERIDMVTQQHIRTYWEGKEEVTVYSTLKLYTFTLACNLFASINDPERLSKLGAHFDVFVKGVISLPISIPGTRLYKSMKAANAIREELKLIVRDRKEALERKMASPTQDLLSYLLVDSDTNGRFLSEMEILDNIMLLLYAEQLEIANSKKPGELLQWEDVQKMRYSWNVISEVLRLSPPVSSAYRHAIVDFTYEGYTIPKGWQLFTSFGTTHRDPALFPNPERFDASRFEGNGPPSYSYIPFGGGPRMCIGYEFARLEMLIFLHNIIKRFKWDILIPDEQFGYNPLLAPSQGFPVRLRPHHSHL

SEQ ID NO: 128 - protein, 476 aa, Artificial Sequence
  Synthetic construct
MIQVLTPILLFLIFFVFWKVYKHQKTKINLPPGSFGWPFLGETLALLRAGWDSEPERFVRERIKKHGSPLVFKTSLFGDRFAVLCGPAGNKFLFCNENKLVASWWPVPVRKLFGKSLLTIRGDEAKWMRKMLLSYLGPDAFATHYAVTMDVVTRRHIDVHWRGKEEVNVFQTVKLYAFELACRLFMNLDDPNHIAKLGSLFNIFLKGIIELPIDVPGTRFYSSKKAAAAIRIELKKLIKARKLELKEGKASSSQDLLSHLLTSPDENGMFLTEEEIVDNILLLLFAGHDTSALSITLLMKTLGEHSDVYDKVLKEQLEISKTKEAWESLKWEDIQKMKYSWSVICEVMRLNPPVIGTYREALVDIDYAGYTIPKGWKLHWSAVSTQRDEANFEDVTRFDPSRFEGAGPTPFTFVPFGGGPRMCLGKEFARLEVLAFLHNIVTNFKWDLLIPDEKIEYDPMATPAKGLPIRLHPHQV

SEQ ID NO: 129 - protein, 525 aa, Artificial Sequence
  Synthetic construct
MESLVVHTVNAIWCIVIVGIFSVGYHVYGRAVVEQWRMRRSLKLQGVKGPPPSIFNGNVSEMQRIQSEAKHCSGDNIISHDYSSSLFPHFDHWRKQYGRIYTYSTGLKQHLYINHPEMVKELSQTNTLNLGRITHITKRLNPILGNGIITSNGPHWAHQRRIIAYEFTHDKIKGMVGLMVESAMPMLNKWEEMVKRGGEMGCDIRVDEDLKDVSADVIAKACFGSSFSKGKAIFSMIRDLLTAITKRSVLFRFNGFTDMVFGSKKHGDVDIDALEMELESSIWETVKEREIECKDTHKKDLMQLILEGAMRSCDGNLWDKSAYRRFVVDNCKSIYFAGHDSTAVSVSWCLMLLALNPSWQVKIRDEILSSCKNGIPDAESIPNLKTVTMVIQETMRLYPPAPIVGREASKDIRLGDLVVPKGVCIWTLIPALHRDPEIWGPDANDFKPERFSEGISKACKYPQSYIPFGLGPRTCVGKNFGMMEVKVLVSLIVSKFSFTLSPTYQHSPSHKLLVEPQHGVVIRVV

SEQ ID NO: 130 - protein, 522 aa, Artificial Sequence
  Synthetic construct
MGLFPLEDSYALVFEGLAITLALYYLLSFIYKTSKKTCTPPKASGEHPITGHLNLLSGSSGLPHLALASLADRCGPIFTIRLGIRRVLVVSNWEIAKEIFTTHDLIVSNRPKYLAAKILGFNYVSFSFAPYGPYWVGIRKIIATKLMSSSRLQKLQFVRVFELENSMKSIRESWKEKKDEEGKVLVEMKKWFWELNMNIVLRTVAGKQYTGTVDDADAKRISELFREWFHYTGRFVVGDAFPFLGWLDLGGYKKTMELVASRLDSMVSKWLDEHRKKQANDDKKEDMDFMDIMISMTEANSPLEGYGTDTIIKTTCMTLIVSGVDTTSIVLTWALSLLLNNRDTLKKAQEELDMCVGKGRQVNESDLVNLIYLEAVLKEALRLYPAAFLGGPRAFLEDCTVAGYRIPKGTCLLINMWKLHRDPNIWSDPCEFKPERFLTPNQKDVDVIGMDFELIPFGAGRRYCPGTRLALQMLHIVLATLLQNFEMSTPNDAPVDMTASVGMTNAKASPLEVLLSPRVKWS

SEQ ID NO: 131 - protein, 525 aa, Artificial Sequence
  Synthetic construct
MGLFPLEDSYALVFEGLAITLALYYLLSFIYKTSKKTCTPPKASGEIIPITGIILNLLSGSSGLPIILALASLADRCGPIFTIRLGIRRVLVVSNWEIAKEIFTTHDLIVSNRPKYLAAKILGFNYVSFSFAPYGPYWVGIRKIIATKLMSSSRLQKLQFVRVFELENSMKSIRESWKEKKDEEGKVLVEMKKWFWELNMNIVLRTVAGKQYTGTVDDADAKRISELFREWFHYTGRFVVGDAFPFLGWLDLGGYKKTMELVASRLDSMVSKWLDEHRKKQANDDKKEDMDFMDIMISMTEANSPLEGYGTDTIIKTTCMTLIVSGVDTTSIVLTWALSLLLNNRDTLKKAQEELDMCVGKGRQVNESDLVNLIYLEAVLKEALRLYPAAFLGGPRAFLEDCTVAGYRIPKGTCLLINMWKLHRDPNIWSDPCEFKPERFLTPNQKDVDVIGMDFELIPFGAGRRYCPGTRLALQMLHIVLATLLQNFEMSTPNDAPVDMTASVGMTNAKASPLEVLLSPRVKWS

SEQ ID NO: 132 - protein, 476 aa, Artificial Sequence; identical to SEQ ID NO: 128
  Synthetic construct

SEQ ID NO: 133 - protein, 525 aa, Artificial Sequence; identical to SEQ ID NO: 129
  Synthetic construct

SEQ ID NO: 134 - protein, 529 aa, Artificial Sequence
  Synthetic construct
MYFLLQYLNITTVGVFATLFLSYCLLLWRSRAGNKKIAPEAAAAWPIIGHLHLLAGGSHQLPHITLGNMADKYGPVFTIRIGLHRAVVVSSWEMAKECSTANDQVSSSRPELLASKLLGYNYAMFGFSPYGSYWREMRKIISLELLSNSRLELLKDVRASEVVTSIKELYKLWAEKKNESGLVSVEMKQWFGDLTLNVILRMVAGKRYFSASDASENKQAQRCRRVFREFFHLSGLFVVADAIPFLGWLDWGRHEKTLKKTAIEMDSIAQEWLEEHRRRKDSGDDNSTQDFMDVMQSVLDGKNLGGYDADTINKATCLTLISGGSDTTVVSLTWALSLVLNNRDTLKKAQEELDIQVGKERLVNEQDISKLVYLQAIVKETLRLYPPGPLGGLRQFTEDCTLGGYHVSKGTRLIMNLSKIQKDPRIWSDPTEFQPERFLTTHKDVDPRGKHFEFIPFGAGRRACPGITFGLQVLHLTLASFLHAFEFSTPSNEQVNMRESLGLTNMKSTPLEVLISPRLSLNCFNLMKI

SEQ ID NO: 135 - protein, 479 aa, Artificial Sequence
  Synthetic construct
MEPNFYLSLLLLFVTFISLSLFFIFYKQKSPLNLPPGKMGYPIIGESLEFLSTGWKGHPEKFIFDRMRKYSSELFKTSIVGESTVVCCGAASNKFLFSNENKLVTAWWPDSVNKIFPTTSLDSNLKEESIKMRKLLPQFFKPEALQRYVGVMDVIAQRHFVTHWDNKNEITVYPLAKRYTFLLACRLFMSVEDENHVAKFSDPFQLIAAGIISLPIDLPGTPFNKAIKASNFIRKELIKIIKQRRVDLAEGTASPTQDILSHMLLTSDENGKSMNELNIADKILGLLIGGHDTASVACTFLVKYLGELPHIYDKVYQEQMEIAKSKPAGELLNWDDLKKMKYSWNVACEVMRLSPPLQGGFREAITDFMFNGFSIPKGWKLYWSANSTHKNAECFPMPEKFDPTRFEGNGPAPYTFVPFGGGPRMCPGKEYARLEILVFMHNLVKRFKWEKVIPDEKIIVDPFPIPAKDLPIRLYPHKA

SEQ ID NO: 136 - DNA, 1440 bp, Artificial Sequence
  Synthetic construct
atgccaatgaccgtcatgttgttgttcgttttcttattattcattgccatctgtttcttcttggtccacagacacaactccaccaccaccaagaacttgccaccaggttctttcggttggccattcatcggtgaaactttggcttacatcagatccaagagaggtggtgacccagaaagattcaccaaggaaagaattgaaaagtacggttccactttagtctttaagacctctgttgctggtgaaagaatggctgtcttttgtggtccagaaggtaacaagttcttgtttggtaacgaaaacaaattggttgcttcctggtggccaaactctgttagaattttgttcgaaaagtgtttgattaccatcagaggtgacgaagctaaatggttacgtaaaatgatgttcgcttacttgggtccagacgctctatccaacagatacactggtactatggaagttgttaccagattgcacatccaaaaccactggcaaggtaagtctgaattgaaggtctttgaaaccgttagaccatacttgttcgaattggcctgtagattattcttgtctttggatgacccaaagcacgttgctgaattgggtactttattcaacactttcttgaagggtttgactgaattgccaatcaacattccaggtactagattctacagagccaagagagctgccaacgccatcaagaaacaattgattgtcatcatcaagcaacgtcgtcaagctttgaagcaagaagatcaatcttcttctttcgaagatttgctatctcatttgttagtctcctctgatgaaaacggtagattcttgtccgaagctgaaattgccaataatgtcttgttgttgttgtttgctggtcacgacacttctgctgtttccatcactttgttgatgaagtctttggctgaacaccctcaagtctacgacaacgttttgaaggaacaattaggtatcttggaagccaaggctccaggtgaaatgttgaactgggaagatatccaaaagatgagatactcctggtacgttgtttgtgaagtcatgagattgattccacctgttgttggttctttcagagaagctttggttgatttcgaatacgctggttacactattccaaagggttggaagatcatctggtctgctgtcatgactcacaaggaagaaaacaacttcccaaacgctactaagttcgacccatccagattcgaaggtgctggtccaaccccattcacctacgttccattcggtggtggtccaagaatgtgtttgggtaaggaattggctcgtgtcagaattttggttttcttacataacatcatgaccaaattcaaatgggacttgttgattccagacgaaaagatcggttacgacccattggctaccccagtcaagggtttgccagtcagattgcaccctcaccaagtg

SEQ ID NO: 137 - DNA, 1365 bp, Artificial Sequence
  Synthetic construct
atggaattggtcatgttcccagtcttggctttggtttccactttgttcttgttggctttgcacttcatcatcagaactttgaaggaaagattattcggttctccaaatttgccaccaggtagattaggttggccattgattggtgaaaccccagctttcttcagagctggtttcgaagccaagccagaaaagttcatcggtgaaagaatggaaaagtacgactctcgtgttttcaagacctctttgttgggtaagcctttcgctgtcatttctggtactgctggtcacaagttcttgttttccaacgaaaacaaattggttaacttgtggtggccagaatccgtcagaatgttgttcaagtctgctttggtttccgttgttggtgacgaagccaagagaatcagaaagatgttgatgactttcttaggtttggatgctttgaagaactacactgaaagaattgacatggtcacccaacaacacatcagaacctactgggaaggtaaggaagaagttaccgtttactccactttgaaattgtacactttcaccttggcttgtaacttgtttgcctccatcaacgaccctgaaagattatccaagttgggtgctcacttcgatgttttcgttaagggtgttatctctttgccaatttccattccaggtactagattatacaaatccatgaaggctgccaacgccattagagaagaattgaaattgattgtccgtgacagaaaggaagctttggaaagaaagatggcttctccaactcaagatttgttgtcttatttgttggtcgactctgacaccaacggtcgtttcttgtctgaaatggaaatcttggacaacatcatgttgctattgtacgctgaacaattggaaattgctaactccaagaagccaggtgaattattgcaatgggaagatgtccaaaagatgagatactcctggaacgtcatctctgaagtcttgagattgtctccaccagtttcttctgcttacagacacgccattgttgactttacctacgaaggttacaccattccaaagggttggcaattgttcacctctttcggtactacccaccgtgacccagctttattcccaaacccagaaagattcgatgcttccagatttgaaggtaacggtccaccttcttactcttacatcccattcggtggtggtccaagaatgtgtattggttacgaatttgccagattggaaatgttgatcttcttacataacatcatcaagagattcaaatgggatatcttgatcccagatgaacaattcggttacaacccattattggctccatctcaaggtttcccagtcagattaagaccacaccactctcatcta

SEQ ID NO: 138 - DNA, 1428 bp, Artificial Sequence
  Synthetic construct
atgattcaagttttgaccccaatcttgttgttcttgatcttcttcgtcttttggaaggtctacaagcaccaaaagaccaagatcaacttgcctccaggttctttcggttggccattcttgggtgaaactttagctttgttgagagctggttgggactctgaaccagaaagattcgttagagaaagaatcaagaagcatggttctccattggttttcaagacctctttgttcggtgacagattcgctgtcttgtgtggtccagctggtaacaaattcttgttctgtaacgaaaacaaattggttgcttcctggtggccagttccagttagaaagttgttcggtaagtccttgttgactatcagaggtgacgaagccaagtggatgagaaagatgttattgtcttacttgggtccagatgcctttgctacccactacgctgtcaccatggacgttgttacccgtcgtcacattgatgtccactggagaggtaaggaagaagttaacgttttccaaaccgtcaaattgtacgctttcgaattggcttgtagattattcatgaacttggatgacccaaaccatattgccaaattaggttctttattcaacatcttcttgaagggtatcatcgaattgccaattgatgttccaggtactagattctactcctccaagaaggctgctgctgccatcagaattgaattgaagaaattgatcaaggccagaaagttggaattgaaggaaggtaaggcttcttcctctcaagatttgctatcccacttattgacctctccagacgaaaatggtatgttcttgactgaagaagaaattgtcgacaacatcttattgctattgttcgctggtcacgacacctctgctctatccattactttgttgatgaaaactttgggtgaacactctgatgtttacgacaaggtcttaaaggaacaattggaaatctccaagactaaggaagcttgggaatctttgaaatgggaagatatccaaaagatgaagtactcctggtctgttatctgtgaagtcatgagattgaaccctccagtcattggtacttacagagaagctttggtcgatatcgactacgctggttacaccattccaaagggttggaagttgcactggtctgccgtttccactcaaagagatgaagctaacttcgaagatgtcaccagatttgacccatctcgtttcgaaggtgctggtccaactccattcacttttgttccattcggtggtggtccaagaatgtgtttgggtaaggaattcgctagattagaagttttggctttcttgcacaacattgtcaccaactttaaatgggacttgttgattccagacgaaaagatcgaatacgacccaatggctactccagccaagggtttgccaatcagattgcaccctcaccaagtc

SEQ ID NO: 139 - DNA, 1575 bp, Artificial Sequence
  Synthetic construct
atggaatctttagtcgttcacaccgtcaatgccatctggtgtattgtcattgttggtattttctctgttggttaccacgtttacggtcgtgccgttgttgaacaatggagaatgagaagatctttgaaattgcaaggtgtcaagggtccaccaccatccattttcaacggtaatgtctctgaaatgcaaagaatccaatctgaagctaagcactgttccggtgacaacatcatttctcacgattactcctcctctttgttccctcactttgaccactggagaaagcaatacggtagaatctacacctactccactggtttgaaacaacatttgtacatcaaccatccagaaatggtcaaggaattatctcaaaccaacactttgaacttaggtcgtatcactcacatcaccaagagattgaacccaatcttaggtaacggtatcatcacttccaacggtccacactgggctcatcaaagaagaattattgcttacgaattcacccacgacaaaatcaagggtatggtcggtttgatggtcgaatctgccatgccaatgttgaacaaatgggaagaaatggttaagagaggtggtgaaatgggttgtgacatccgtgttgacgaagatttgaaggatgtttctgctgatgtcattgctaaggcttgtttcggttcctctttctccaagggtaaggctatcttctccatgatcagagacttgttgactgccatcactaagagatctgttttgttcagattcaacggtttcaccgacatggttttcggttccaagaagcatggtgatgtcgatatcgatgctttggaaatggaattggaatcttctatctgggaaaccgttaaggaaagagaaattgaatgtaaggacactcacaagaaggatttgatgcaattaatcttggaaggtgccatgagatcttgtgacggtaacttgtgggacaagtctgcttacagaagatttgttgtcgacaactgtaaatccatctactttgccggtcacgactctactgctgtctccgtttcctggtgtttgatgttgctagctttgaacccatcctggcaagtcaagatcagagatgaaatcttatcttcttgtaagaacggtattccagatgctgaatccattccaaacttgaagaccgttaccatggtcattcaagaaactatgagattgtacccaccagctccaattgtcggtagagaagcttccaaggacatcagattaggtgacttggttgttccaaagggtgtttgtatctggactttgattccagctttgcaccgtgacccagaaatctggggtccagatgctaacgacttcaagccagaaagattctctgaaggtatttccaaggcttgtaaatacccacaatcttacatcccattcggtttgggtccaagaacctgtgtcggtaagaacttcggtatgatggaagtcaaagttttggtttctttgattgtttccaagttctctttcaccttgtctccaacttaccaacactctccatctcacaagttgttggttgaacctcaacacggtgttgtcattagagtcgtt

SEQ ID NO: 140 - DNA, 1566 bp, Artificial Sequence
  Synthetic construct
atgggtttgttcccattggaagactcttacgctttggttttcgaaggtttggccatcactttggctttgtactacctattgtctttcatctacaagacctccaagaagacctgtaccccaccaaaggcttctggtgaacacccaattaccggtcatttaaacttgttgtctggttcttccggtttgccacacttggctttggcttctttggctgacagatgtggtcctatcttcaccatcagattaggtatcagaagagttttggttgtttccaactgggaaattgccaaggaaatctttaccacccacgacttgattgtctccaacagaccaaagtacttggctgccaagatcttaggtttcaactacgtttctttctctttcgctccatacggtccatactgggttggtatcagaaagattattgctactaaattgatgtcttcttctagattgcaaaagttgcaattcgtccgtgtctttgaattggaaaactccatgaaatccatcagagaatcctggaaggaaaagaaggatgaagaaggtaaggtcttggttgaaatgaagaagtggttctgggaattgaatatgaacattgtcttgagaaccgttgctggtaagcaatacactggtactgttgacgatgctgatgccaagagaatttctgaattgttcagagaatggttccactacactggtagattcgttgtcggtgatgctttcccatttctaggttggttggatttaggtggttacaagaagaccatggaattggttgcctccagattagattccatggtcagcaaatggttggacgaacacagaaagaagcaagctaacgatgacaagaaggaagacatggacttcatggacatcatgatctccatgactgaagctaactctccattggaaggttacggtactgacaccatcatcaagaccacttgtatgactttgattgtttccggtgtcgacaccacttctatcgttttgacctgggctttgtctttgttgttgaacaacagagacactttaaagaaggctcaagaagaattggacatgtgtgtcggtaagggtagacaagtcaatgaatctgatttggtcaacttaatctatttagaagctgtcttgaaagaagctttgagattgtacccagctgctttcttgggtggtcctcgtgctttcttggaagactgtaccgttgccggttacagaattccaaagggtacttgtttgttgatcaacatgtggaaattgcacagagatccaaacatctggtctgacccatgtgaattcaaaccagaaagattcttgactccaaaccaaaaggatgttgatgtcattggtatggacttcgaattgattccattcggtgctggtcgtcgttactgtccaggtaccagattagctttgcaaatgttgcacattgtcttggccactctattacaaaactttgaaatgtccactccaaacgatgctccagttgacatgactgcttccgttggtatgaccaacgccaaggcttctccattggaagttttgttgtctccaagagtcaaatggtct

SEQ ID NO: 141 - DNA, 1575 bp, Artificial Sequence
  Synthetic construct
atgggtttgttcccattagaggattcctacgcgctggtctttgaaggactagcaataacactggctttgtactatctactgtctttcatctacaaaacatctaaaaagacatgtacacctcctaaagcatctggtgaaatcattccaattacaggaatcatattgaatctgctatctggctcaagtggtctacctattatcttagcacttgcctctttagcagacagatgtggtcctattttcaccattaggctgggtattaggagagtgctagtagtatcaaattgggaaatcgctaaggagattttcactacccacgatttgatagtttctaatagaccaaaatacttagccgctaagattcttggtttcaattatgtttcattctctttcgctccatacggcccatattgggtcggaatcagaaagattattgctacaaaactaatgtcttcttccagacttcagaagttgcaatttgtaagagtttttgaactagaaaactctatgaaatctatcagagaatcatggaaggagaaaaaggatgaagagggaaaggtattagttgagatgaaaaagtggttctgggaactgaatatgaacatagtgttaaggacagttgctggtaaacaatacactggtacagttgatgatgccgatgcaaagcgtatctccgagttattcagagaatggtttcactacactggcagatttgtcgttggagatgcttttccttttctaggttggttggacctgggcggatacaaaaagacaatggaattagttgctagtagattggactcaatggtcagtaaatggttagatgagcatcgtaaaaagcaagctaacgatgacaaaaaggaggatatggatttcatggatatcatgatctccatgacagaagcaaattcaccacttgaaggatacggcactgatactattatcaagaccacatgtatgactttgattgtttcaggagttgatacaacctcaatcgtacttacttgggccttatcacttttgttaaacaacagagatactttgaaaaaggcacaagaggaattagatatgtgcgtaggtaaaggaagacaagtcaacgagtctgatcttgttaacttgatatacttggaagcagtgcttaaagaggctttaagactttacccagcagcgttcttaggcggaccaagagcattcttggaagattgtactgttgctggttatagaattccaaagggcacctgcttgttgattaacatgtggaaactgcatagagatccaaacatttggagtgatccttgcgaattcaagccagaaagatttttgacacctaatcaaaaggatgttgatgtgatcggtatggatttcgaattgataccatttggtgccggcagaagatattgtccaggtactagattggctttacagatgttgcatatcgtattagcgacattgctgcaaaacttcgaaatgtcaacaccaaacgatgcgccagtcgatatgactgcttctgttggcatgacaaatgccaaagcatcacctttagaagtcttgctatcacctcgtgttaaatggtcc

SEQ ID NO: 142 - DNA, 1428 bp, Artificial Sequence
  Synthetic construct
atgatacaagttttaactccaattctactcttcctcatcttcttcgttttctggaaagtctacaaacatcaaaagactaaaatcaatctaccaccaggttccttcggctggccatttttgggtgaaaccttagccttacttagagcaggctgggattctgagccagaaagattcgtaagagagcgtatcaaaaagcatggatctccacttgttttcaagacatcactatttggagacagattcgctgttctttgcggtccagctggtaataagtttttgttctgcaacgaaaacaaattagtggcatcttggtggccagtccctgtaaggaagttgttcggtaaaagtttactcacaataagaggagatgaagcaaaatggatgagaaaaatgctattgtcttacttgggtccagatgcatttgccacacattatgccgttactatggatgttgtaacacgtagacatattgatgtccattggaggggcaaggaggaagttaatgtatttcaaacagttaagttgtacgcattcgaattagcttgtagattattcatgaacctagatgacccaaaccacatcgcgaaactcggtagtcttttcaacattttcctcaaagggatcatcgagcttcctatagacgttcctggaactagattttactccagtaaaaaggccgcagctgccattagaattgaattgaaaaagctcattaaagctagaaaactcgaattgaaggagggtaaggcgtcttcttcacaggacttgctttctcatctattaacatcacctgatgagaatgggatgttcttgacagaagaggaaatagtcgataacattctacttttgttattcgctggtcacgatacctctgcactatcaataacacttttgatgaaaaccttaggtgaacacagtgatgtgtacgacaaggttttgaaggaacaattagaaatttccaaaacaaaggaggcttgggaatcactaaagtgggaagatatccagaagatgaagtactcatggtcagtaatctgtgaagtcatgagattgaatcctcctgtcatagggacatacagagaggcgttggttgatatcgactatgctggttacactatcccaaaaggatggaagttgcattggtcagctgtttctactcaaagagatgaagccaatttcgaagatgtaactagattcgatccatccagatttgaaggggcaggccctactccattcacatttgtgcctttcggtggaggtcctagaatgtgtttaggcaaagagtttgccaggttagaagtgttagcatttctccacaacattgttaccaactttaagtgggatcttctaatccctgatgagaagatcgaatatgatccaatggctactccagctaagggcttgccaattagacttcatccacaccaagtc

SEQ ID NO: 143 - DNA, 1575 bp, Artificial Sequence
  Synthetic construct
atggagtctttagtggttcatacagtaaatgctatctggtgtattgtaatcgtcgggattttctcagttggttatcacgtttacggtagagctgtggtcgaacaatggagaatgagaagatcactgaagctacaaggtgttaaaggcccaccaccatccatcttcaatggtaacgtttcagaaatgcaacgtatccaatccgaagctaaacactgctctggcgataacattatctcacatgattattcttcttcattattcccacacttcgatcactggagaaaacagtacggcagaatctacacatactctactggattaaagcaacacttgtacatcaatcatccagaaatggtgaaggagctatctcagactaacacattgaacttgggtagaatcacccatataaccaaaagattgaatcctatcttaggtaacggaatcataacctctaatggtcctcattgggcccatcagcgtagaattatcgcctacgagtttactcatgataagatcaagggtatggttggtttgatggttgagtctgctatgcctatgttgaataagtgggaggagatggtaaagagaggcggagaaatgggatgcgacataagagttgatgaggacttgaaagatgtttcagcagatgtgattgcaaaagcctgtttcggatcctcattttctaaaggtaaggctattttctctatgataagagatttgcttacagctatcacaaagagaagtgttctattcagattcaacggattcactgatatggtctttgggagtaaaaagcatggtgacgttgatatagacgctttagaaatggaattggaatcatccatttgggaaactgtcaaggaacgtgaaatagaatgtaaagatactcacaaaaaggatctgatgcaattgattttggaaggggcaatgcgttcatgtgacggtaacctttgggataaatcagcatatagaagatttgttgtagataattgtaaatctatctacttcgcagggcatgatagtacagctgtctcagtgtcatggtgtttgatgttactggccctaaacccatcatggcaagttaagatccgtgatgaaattctgtcttcttgcaaaaatggtattccagatgccgaaagtatcccaaaccttaaaacagtgactatggttattcaagagacaatgagattataccctccagcaccaatcgtcgggagagaagcctctaaagatatcagattgggcgatctagttgttcctaaaggcgtctgtatatggacactaataccagctttacacagagatcctgagatttggggaccagatgcaaacgatttcaaaccagaaagattttctgaaggaatttcaaaggcttgtaagtatcctcaaagttacattccatttggtctgggtcctagaacatgcgttggtaaaaactttggcatgatggaagtaaaggttcttgtttccctgattgtctccaagttctctttcactctatctcctacctaccaacatagtcctagtcacaaacttttagtagaaccacaacatggggtggtaattagagtggtt

SEQ ID NO: 144 - DNA, 1587 bp, Artificial Sequence
  Synthetic construct
atgtacttcctactacaatacctcaacatcacaaccgttggtgtctttgccacattgtttctctcttattgtttacttctctggagaagtagagcgggtaacaaaaagattgccccagaagctgccgctgcatggcctattatcggccacctccacttacttgcaggtggatcccatcaactaccacatattacattgggtaacatggcagataagtacggtcctgtattcacaatcagaataggcttgcatagagctgtagttgtctcatcttgggaaatggcaaaggaatgttcaacagctaatgatcaagtgtcttcttcaagacctgaactattagcttctaagttgttgggttataactacgccatgtttggtttttcaccatacggttcatactggagagaaatgagaaagatcatctctctcgaattactatctaattccagattggaactattgaaagatgttagagcctcagaagttgtcacatctattaaggaactatacaaattgtgggcggaaaagaagaatgagtcaggattggtttctgtcgagatgaaacaatggttcggagatttgactttaaacgtgatcttgagaatggtggctggtaaaagatacttctccgcgagtgacgcttcagaaaacaaacaggcccagcgttgtagaagagtcttcagagaattcttccatctctccggcttgtttgtggttgctgatgctataccttttcttggatggctcgattggggaagacacgagaagaccttgaaaaagaccgccatagaaatggattccatcgcccaggagtggcttgaggaacatagacgtagaaaagattctggagatgataattctacccaagatttcatggacgttatgcaatctgtgctagatggcaaaaatctaggcggatacgatgctgatacgattaacaaggctacatgcttaactcttatatcaggtggcagtgatactactgtagtttctttgacatgggctcttagtcttgtgttaaacaatagagatactttgaaaaaggcacaggaagagttagacatccaagtcggtaaggaaagattggttaacgagcaagacatcagtaagttagtttacttgcaagcaatagtaaaagagacactcagactttatccaccaggtcctttgggtggtttgagacaattcactgaagattgtacactaggtggctatcacgtttcaaaaggaactagattaatcatgaacttatccaagattcaaaaagatccacgtatttggtctgatcctactgaattccaaccagagagattccttacgactcataaagatgtcgatccacgtggtaaacactttgaattcattccattcggtgcaggaagacgtgcatgtcctggtatcacattcggattacaagtactacatctaacattggcatctttcttgcatgcgtttgaattttcaacaccatcaaatgagcaggttaacatgagagaatcattaggtcttacgaatatgaaatctaccccattagaagttttgatttctccaagactatcccttaattgcttcaaccttatgaaaatt

SEQ ID NO: 145 - DNA, 1437 bp, Artificial Sequence
  Synthetic construct
atggaacctaacttttacttgtcattactattgttgttcgtgaccttcatttctttaagtctgtttttcatcttttacaaacaaaagtccccattgaatttgccaccagggaaaatgggttaccctatcataggtgaaagtttagaattcctatccacaggctggaagggacatcctgaaaagttcatatttgatagaatgcgtaagtacagtagtgagttattcaagacttctattgtaggcgaatccacagttgtttgctgtggggcagctagtaacaaattcctattctctaacgaaaacaaactggtaactgcctggtggccagattctgttaacaaaatcttcccaacaacttcactggattctaatttgaaggaggaatctataaagatgagaaagttgctgccacagttcttcaaaccagaagcacttcaaagatacgtcggcgttatggatgtaatcgcacaaagacattttgtcactcactgggacaacaaaaatgagatcacagtttatccacttgctaaaagatacactttcttgcttgcgtgtagactgttcatgtctgttgaggatgaaaatcatgtggcgaaattctcagacccattccaactaatcgctgcaggcatcatttcacttcctatcgatcttcctggtactccattcaacaaggccataaaggcttcaaatttcattagaaaagagctgataaagattatcaaacaaagacgtgttgatctggcagagggtacagcatctccaacccaggatatcttgtcacatatgctattaacatctgatgaaaacggtaaatctatgaacgagttgaacattgccgacaagattcttggactattgataggaggccacgatacagcttcagtagcttgcacatttctagtgaagtacttaggagaattaccacatatctacgataaagtctaccaagagcaaatggaaattgccaagtccaaacctgctggggaattgttgaattgggatgacttgaaaaagatgaagtattcatggaatgtggcatgtgaggtaatgagattgtcaccacctttacaaggtggttttagagaggctataactgactttatgtttaacggtttctctattccaaaagggtggaagttatactggtccgccaactctacacacaaaaatgcagaatgtttcccaatgcctgagaaattcgatcctaccagatttgaaggtaatggtccagcgccttatacatttgtaccattcggtggaggccctagaatgtgtcctggaaaggaatacgctagattagaaatcttggttttcatgcataatctggtcaaacgttttaagtgggaaaaggttattccagacgaaaagattattgtcgatccattcccaatcccagctaaagatcttccaatccgtttgtatcctcacaaagct

SEQ ID NO: 146 - DNA, 1566 bp, Artificial Sequence
  Synthetic construct
atgggtctgttccccctcgaggactcctacgctctggtctttgagggcctcgccatcaccctcgccctctactacctgctctccttcatctacaagacctccaagaaaacctgcactcctcccaaggcctccggtgagcaccccatcaccggccacctcaacctgctctccggctcttccggcctcccccacctcgccctcgcctctctggctgaccgatgtggtcccatcttcaccatccgactcggtatccgacgagtcctcgttgtctccaactgggagattgccaaggagatcttcaccacccacgatctcattgtctccaaccgacccaagtacctggctgccaagattctcggtttcaactacgtttccttctcctttgccccctacggcccctactgggtcggtatccgaaagatcattgccaccaagctcatgtcctcttctcgactccagaagctccagttcgtccgagtctttgagctcgagaactccatgaagtccatccgagagtcttggaaggagaagaaggacgaggaaggcaaggttctggtcgagatgaagaagtggttctgggagctcaacatgaacattgttctgcgaactgttgctggtaagcagtacaccggtaccgtcgacgacgccgatgccaagcgaatctccgagctcttccgagagtggttccactacaccggccgatttgttgtcggtgacgccttccccttcctcggctggctcgatctcggtggctacaagaaaaccatggagctcgtcgcctcccgactcgactccatggtcagcaagtggctcgacgagcaccgaaagaagcaggccaacgacgacaagaaagaggacatggacttcatggacatcatgatctccatgaccgaggccaactctcccctcgagggttacggtaccgacaccatcatcaagaccacctgcatgaccctcattgtctccggtgtcgacaccacctccattgtcctgacctgggctctgtctctgctgctcaacaaccgagacactctcaagaaggcccaggaagagctcgacatgtgtgtcggcaagggccgacaggtcaacgagtccgatctggtcaacctcatctacctcgaggctgttctcaaggaagctctgcgactctaccccgctgccttcctcggtggtccccgagccttcctcgaggactgcactgttgccggctaccgaatccccaagggtacctgtctgctcatcaacatgtggaagctccaccgagatcccaacatctggtccgacccctgcgagttcaagcccgagcgattcctgacccccaaccagaaggacgttgatgtcattggtatggacttcgagctcatccccttcggtgccggccgacgatactgccccggtacccgactcgccctccagatgctgcacattgttctcgccactctgctccagaactttgagatgtccacccccaacgacgcccccgtcgacatgactgcttccgtcggtatgaccaacgccaaggcttctcctctcgaggtcctcctgtctccccgagtcaagtggtca

SEQ ID NO: 147 - DNA, 1440 bp, Artificial Sequence
  Synthetic construct
atgcccatgaccgtcatgctgctctttgttttcctgctcttcattgccatctgtttcttcctcgtccaccgacacaactccaccaccaccaagaacctgcctcccggctccttcggctggcccttcattggtgagactctcgcctacatccgatccaagcgaggtggtgaccccgagcgattcaccaaggagcgaatcgagaagtacggctccactctggtctttaagacctccgttgccggtgagcgaatggccgttttctgcggtcccgagggtaacaagttcctctttggcaacgagaacaagctcgttgcttcttggtggcccaactccgtccgaattctcttcgagaagtgtctgatcaccatccgaggtgacgaggccaagtggctccgaaagatgatgttcgcctacctcggtcccgatgctctgtccaaccgatacaccggtaccatggaggttgtcacccgactccacatccagaaccactggcagggcaagtccgagctcaaggtctttgagactgtccgaccttacctcttcgagctcgcctgccgactcttcctgtctctcgacgaccccaagcacgttgccgagctcggtaccctcttcaacaccttcctcaagggtctgaccgagctccccatcaacatccccggtacccgattctaccgagccaagcgagctgccaacgccatcaagaagcagctcattgtcatcatcaagcagcgacgacaggctctcaagcaagaggaccagtcctcctccttcgaggacctcctctcccacctccttgtctcctccgacgagaacggccgattcctgtccgaggctgagattgccaacaacgttctgctcctcctcttcgccggccacgacacttctgctgtctccatcactctgctcatgaagtctctggccgagcacccccaggtctacgacaacgtcctcaaggagcagctcggtattctcgaggccaaggctcccggtgagatgctcaactgggaggatatccagaagatgcgatactcttggtacgttgtctgcgaggtcatgcgactcattcctcccgttgtcggctctttccgagaggctctggtcgactttgagtacgccggctacaccatccccaagggctggaagatcatctggtccgccgtcatgacccacaaagaggagaacaacttccccaacgccaccaagttcgacccctctcgattcgagggtgctggtcccacccccttcacctacgtccccttcggtggtggcccccgaatgtgcctcggcaaggagctcgcccgagtccgaatcctcgtctttctgcacaacatcatgaccaagttcaagtgggatctgctcatccccgacgagaagattggctacgaccccctcgccacccccgtcaagggtctgcccgtccgactccacccccaccaggtt

SEQ ID NO: 148 - DNA, 1365 bp, Artificial Sequence
  Synthetic construct
atggagctcgtcatgttccccgttctggctctcgtttccactctcttcctgctcgccctccacttcatcatccgaaccctcaaggagcgactctttggctctcccaacctgcctcccggccgactcggctggcccctcattggtgagactcccgccttcttccgagctggctttgaggccaagcccgagaagttcatcggtgagcgaatggagaagtacgactcccgagtctttaagacctctctgctcggcaagcccttcgccgtcatctccggtaccgccggccacaagttcctcttctccaacgagaacaagctcgtcaacctgtggtggcccgagtccgtccgaatgctcttcaagtctgctctcgtttccgttgtcggtgacgaggccaagcgaatccgaaagatgctcatgaccttcctcggcctcgatgctctcaagaactacaccgagcgaattgacatggtcacccagcagcacatccgaacctactgggagggtaaagaggaagtcaccgtctactccactctcaagctctacaccttcactctggcctgcaacctcttcgcctccatcaacgaccccgagcgactctccaagctcggtgcccacttcgacgtctttgtcaagggtgtcatctctctgcccatctccatccccggtacccgactctacaagtccatgaaggctgccaacgccatccgagaggagctcaagctcattgtccgagatcgaaaagaggctctcgagcgaaagatggcctcccccacccaggatctgctctcctacctgctcgtcgactccgacaccaacggccgattcctgtccgagatggagattctcgacaacatcatgctgctcctctacgctgagcagctcgagattgccaactccaagaagcccggtgagctgctccagtgggaggacgtccagaagatgcgatactcttggaacgtcatctccgaggttctgcgactgtctcctcccgtttcttctgcctaccgacacgccattgttgacttcacctacgagggttacaccatccccaagggctggcagctcttcacctccttcggtaccacccaccgagatcccgctctcttccccaaccccgagcgattcgacgcctctcgattcgagggtaacggtcctccctcctactcctacatccccttcggtggtggtccccgaatgtgcattggctacgagtttgcccgactcgagatgctcatcttcctgcacaacatcatcaagcgattcaagtgggacattctcatccccgacgagcagtttggctacaaccccctgctcgccccctcccagggtttccccgtccgactgcgaccccaccactcccatctc

SEQ ID NO: 149 - DNA, 1428 bp, Artificial Sequence
  Synthetic construct
atgatccaggttctgacccccatcctcctcttcctcatcttcttcgttttctggaaggtctacaagcaccaaaagaccaagatcaacctgccccctggctccttcggctggcccttcctcggtgagactcttgctctgctccgagccggctgggactccgagcccgagcgattcgtccgagagcgaatcaagaagcacggctctcctctcgttttcaagacctctctcttcggtgaccgattcgccgttctctgtggtcccgctggtaacaagttcctcttctgcaacgagaacaagctcgttgcctcttggtggcccgtccccgtccgaaagctcttcggcaagtctctgctcaccatccgaggtgacgaggccaagtggatgcgaaagatgctgctctcctacctcggtcccgatgcctttgccacccactacgctgtcaccatggacgttgtcacccgacgacacattgacgtccactggcgaggcaaggaagaggtcaacgttttccagaccgtcaagctctacgcctttgagctcgcctgccgactcttcatgaacctcgacgaccccaaccacattgccaagctcggctctctcttcaacatcttcctcaagggtatcatcgagctccccattgacgttcccggtacccgattctactcctccaagaaggctgctgctgccatccgaatcgagctcaagaagctcatcaaggcccgaaagctcgagctcaaggaaggcaaggcctcctcctcccaggatctgctgtcccacctgctcacctcccccgacgagaacggtatgttcctgaccgaggaagagattgtcgacaacattctgctcctcctctttgccggccacgacacctctgctctgtccatcactctgctcatgaaaactctcggtgagcactccgatgtctacgacaaggtcctcaaggagcagctcgagatctccaagactaaagaggcctgggagtctctcaagtgggaggacatccagaagatgaagtactcctggtccgtcatctgcgaggtcatgcgactcaaccctcccgtcatcggtacctaccgagaggctctggtcgacattgactacgccggctacaccatccccaagggctggaagctccactggtccgctgtctccacccagcgagatgaggccaactttgaggacgtcacccgattcgacccctctcgattcgagggtgccggtcccactcccttcacctttgtccccttcggtggtggtccccgaatgtgtctcggcaaggagtttgcccgactcgaggttctggccttcctgcacaacattgtcaccaacttcaagtgggatctgctcatccccgacgagaagattgagtacgaccccatggccacccccgccaagggtctgcccatccgactccacccccaccaggtg

SEQ ID NO: 150 - DNA, 1575 bp, Artificial Sequence
  Synthetic construct
atggagtctctggttgtccacaccgtcaacgccatctggtgcattgtcattgtcggtatcttctccgtcggctaccacgtctacggccgagctgttgtcgagcagtggcgaatgcgacgatctctcaagctccagggtgtcaagggtcctcctccctccatcttcaacggtaacgtttccgagatgcagcgaatccagtccgaggccaagcactgctccggtgacaacatcatctcccacgactactcttcttctctgttcccccactttgaccactggcgaaagcagtacggccgaatctacacctactccactggcctcaagcagcacctctacatcaaccaccccgagatggtcaaggagctctcccagaccaacaccctcaacctcggccgaatcacccacatcaccaagcgactcaaccccattctcggtaacggtatcatcacctccaacggcccccactgggcccaccagcgacgaatcattgcctacgagttcacccacgacaagatcaagggtatggtcggtctgatggtcgagtccgccatgcccatgctcaacaagtgggaggagatggtcaagcgaggtggtgagatgggctgtgacatccgagtcgacgaggacctcaaggatgtctccgctgacgtcattgccaaggcctgtttcggctcttccttctccaagggcaaggccatcttctccatgatccgagatctgctcaccgccatcaccaagcgatccgtcctcttccgattcaacggtttcaccgacatggttttcggctccaagaagcacggtgacgttgacattgacgctctcgagatggagctcgagtcctccatctgggagactgtcaaggagcgagagattgagtgcaaggacacccacaagaaggacctcatgcagctcattctcgagggtgccatgcgatcttgtgacggtaacctgtgggacaagtctgcttaccgacgattcgttgtcgacaactgcaagtccatctactttgccggccacgactccaccgccgtttccgtttcttggtgcctcatgctgctcgctctcaacccctcttggcaggtcaagatccgagatgagattctgtcctcctgcaagaacggtatccccgacgccgagtccatccccaacctcaagaccgtcaccatggtcatccaggagactatgcgactctaccctcccgctcccattgtcggccgagaggcctccaaggacattcgactcggtgatctggttgtccccaagggtgtctgtatctggaccctcatccccgctctgcaccgagatcccgagatctggggtcccgacgccaacgacttcaagcccgagcgattctccgagggtatctccaaggcctgcaagtacccccagtcctacatcccctttggcctcggcccccgaacctgtgtcggcaagaactttggtatgatggaggtcaaggtcctcgtttctctgattgtctccaagttctccttcactctgtctcccacctaccagcactctccctcccacaagctgctcgtcgagccccagcacggtgttgtcatccgagttgta

SEQ ID NO: 151 - protein, 479 aa, Artificial Sequence
  Synthetic construct
MDAVAVNSETMSHVVFIPFPAQSHIKCMLKLARLLHHKGLHITFVNTELNHNQLLSSGGPNSLDGEPGFRFKTIPDGVPEGAPDFMYALCDSVLNKMLDPFVDLIGRLESPATCIIGDGMMPFTVAAAEKLKLPIMHFWTFPAAAFLGYYQAPNLIEKGFIPPKDESWSTNGYLETVVDSISGLEGFRIRDIPAYFRTTDPNDSDFNYIIECVKAIRKVSNIVLHTFEELESTIIKALQPMIPHVYTIGPLELLLNPIKLEEETEKLDIKGYSLWKEDDECLKWLDSKEPNSVIYVNFGSLISMSKEQLAEFGWGLVNSNHCFLWVIRRDLVVGDSAPLPPELKERINERGFIASWCPQEKVLKHSSVGGFLTHCGWGSIIESLSAGVPMLCWPYLWDQPTNCRQACKEWEVGLEIEGNVNKDEVERLTRELIGGEKGKQMRSKALEWKKKIEIATGPKGSSSLNVERLANDINMFSRN

SEQ ID NO: 152 - protein, 482 aa, Artificial Sequence
  Synthetic construct
MGSIVRDHDKPHVVCVPYPAQGHVNPMVKLAKLLHYNDFHVTFVNTEYNHRRLLNSRGPSSLDGLPDFRFEAISDGLPPSDANATQDIPSLCDSTSKNSLAPFRNLLLKLKSSDSLPPVTCIISDACMSFTLDAAEEFGIPEILFWTPSSCGVLGYSQYHTLIEKGLTPLKDASYLTNGYLETTLDWIPGMKDIRFRDLPSFIRTTDRNDIMLNFVVRELERTSRASAVVFNTFYAFEKDVLDVLSTMFPPIYSIGPLQLLVDQIPIDRNLGNIGSNLWKEQPECIDWLDTKEPNSVVYVNFGSITVITPQQMIEFAWGLASSKKPFLWIIRPDLVIGENAMLPAEFVSETKDRGMLASWGPQEQILKHPAVGGFLSHMGWNSTLDSMSGGVPMVCWPFFAEQQTNCRFACTEWGVGMEIDNNVKRDEVKKLVEVLMDGKKGKEMKSKAMEWKTKAEEAAKPGGSSHNNLDRLVKFIKGQKN

SEQ ID NO: 153 - protein, 481 aa, Artificial Sequence
  Synthetic construct
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 154 - DNA, 1437 bp, Artificial Sequence
  Synthetic construct
atggatgccgttgccgtcaactctgaaaccatgtcccacgttgttttcattccattcccagctcaatctcacatcaagtgtatgttgaagttggcccgtctattacaccacaagggtttacacatcactttcgtcaacactgaattgaaccacaaccaattgttatcttctggtggtccaaactctttggacggtgaaccaggtttcagattcaagaccattccagatggtgttccagaaggtgctccagacttcatgtacgctttatgtgactctgtcttgaacaaaatgttggacccatttgtcgatttgattggtagattggaatctccagccacctgtatcatcggtgacggtatgatgcctttcactgttgctgctgctgaaaagttgaaattgccaattatgcatttctggactttcccagctgctgctttcttgggttactaccaagctccaaacttgattgaaaagggtttcatcccacctaaggacgaatcctggtccaccaacggttacttggaaaccgttgttgactccatttctggtttggaaggtttcagaatcagagatatcccagcttacttcagaaccactgacccaaacgattctgatttcaactacatcatcgaatgtgttaaggccatcagaaaggtttccaacattgtcttgcacactttcgaagaattggaatctaccattatcaaggccttgcaaccaatgatcccacacgtctacaccattggtccattggaattgttgttgaacccaatcaagttagaagaagaaactgaaaagttggacattaaaggttactctttatggaaggaagatgacgaatgtttgaaatggttggactccaaggaaccaaactccgtcatttacgtcaactttggttctttgatctccatgtccaaggaacaattagctgaatttggttggggtttggttaactctaaccactgtttcttgtgggttatcagaagagacttggttgtcggtgattctgctccattgcctccagaattgaaagaacgtatcaacgaaagaggtttcatcgcttcctggtgtccacaagaaaaggtcttgaaacattcctctgttggtggtttcttgactcactgtggttggggttccatcatcgaatctctatctgctggtgtcccaatgttgtgttggccatacttgtgggaccaaccaaccaactgtcgtcaagcttgtaaggaatgggaagttggtttggaaattgaaggtaacgttaacaaggatgaagtcgaaagattgaccagagaattgatcggtggtgaaaagggtaagcaaatgagatccaaggctttggaatggaagaagaagatcgaaattgctactggtccaaagggttcttcttctttaaatgtcgaaagattggctaacgacattaacatgttctccagaaat

SEQ ID NO: 155 - DNA, 1446 bp, Artificial Sequence
  Synthetic construct
atgggttccattgtccgtgaccacgacaagccacacgttgtttgtgttccatacccagctcaaggtcacgttaacccaatggtcaaattggccaagttgttgcactacaacgatttccacgtcactttcgtcaacactgaatacaaccacagaagattattgaactccagaggtccttcttctttggacggtttgccagatttcagattcgaagccatctctgacggtttgccaccatctgatgctaacgctacccaagatatcccatctctatgtgactctacctccaagaactctttggctccattcagaaacttgttgttgaagttgaaatcctctgactctttgccaccagttacctgtatcatttctgatgcttgtatgtccttcactttggatgctgctgaagaatttggtattccagaaatcttattctggaccccatcttcttgtggtgttttgggttactctcaataccacactttgattgaaaagggtttgactccattaaaggacgcctcttacttgaccaacggttacttggaaaccactttggactggattccaggtatgaaggatatcagattcagagatttgccatctttcatcagaaccactgacagaaacgatatcatgttgaactttgttgtccgtgaattggaaagaacttccagagcttctgctgttgttttcaacactttctacgccttcgaaaaggacgtcttagatgtcttatccaccatgttcccaccaatctactccatcggtccattgcaattgttggttgaccaaatcccaattgacagaaacttgggtaacattggttccaacttatggaaggaacaaccagaatgtattgactggttggacaccaaggaaccaaactctgttgtctacgtcaacttcggttccatcactgttatcactcctcaacaaatgattgaattcgcttggggtctagcttcttctaagaaaccattcttatggatcatcagaccagacttggttatcggtgaaaacgctatgttgccagctgaattcgtttctgaaaccaaggatcgtggtatgttggcttcttggggtcctcaagaacaaattttgaaacatccagctgtcggtggtttcttgtctcacatgggttggaactccactttggactccatgtccggtggtgtcccaatggtttgttggccattctttgctgaacaacaaaccaactgtagatttgcttgtaccgaatggggtgttggtatggaaattgacaacaatgtcaagagagatgaagtcaagaagttggttgaagttttgatggacggtaagaaaggtaaggaaatgaagtccaaggccatggaatggaaaaccaaggctgaagaagctgccaagccaggtggttcctctcataacaacttggacagattagtcaagttcatcaagggtcaaaagaat

SEQ ID NO: 156 - DNA, 1443 bp, Artificial Sequence
  Synthetic construct
atggacgctatggccaccactgaaaagaagcctcacgttatctttattccattcccagctcaatctcatatcaaggctatgttgaaattggctcaattattgcaccacaagggtttgcaaatcacttttgtcaacaccgacttcattcacaaccaattcttggaatcttctggtcctcactgtttggacggtgctccaggtttcagattcgaaaccattccagatggtgtttcccactctccagaagcctccatcccaatcagagaatccttgttgagatctattgaaaccaacttcttggaccgtttcatcgatttggttaccaaattgccagacccaccaacctgtatcatttctgacggtttcttgtccgttttcaccatcgatgctgccaagaaattgggtattccagtcatgatgtactggactttggctgcttgtggtttcatgggtttctaccatattcactctttgattgaaaagggtttcgctccattaaaggatgcttcttacttgaccaacggttacttggacaccgtcattgactgggttccaggtatggaaggtatcagattgaaagatttcccattggactggtctactgacttgaatgacaaggtcttgatgttcactactgaagctccacaaagatctcataaggtttctcaccacatcttccacactttcgatgaattagaaccatctatcatcaagactctatccttgagatacaaccatatctacaccattggtccattacaattgttgttggaccaaatcccagaagaaaagaagcaaaccggtatcacttctttgcacggttactctttagtcaaggaagaaccagaatgtttccaatggttacaatccaaggaaccaaactctgttgtctacgttaactttggttccaccactgttatgtccttggaagatatgactgaatttggttggggtttggctaactctaaccactacttcttatggatcatcagatctaacttggtcattggtgaaaacgccgttttgcctccagaattggaagaacacatcaagaagagaggtttcattgcttcctggtgttctcaagaaaaggtcttgaagcacccatctgttggtggtttcttgacccactgtggttggggttccaccattgaatccctatctgctggtgttccaatgatctgttggccatactcctgggaccaattgactaactgtcgttacatctgtaaggaatgggaagttggtttggaaatgggtactaaggtcaagagagatgaagtcaagagattagtccaagaattgatgggtgaaggtggtcacaagatgagaaacaaagccaaggactggaaggaaaaggccagaattgctattgctccaaacggttcttcctccttgaacatcgataaaatggttaaggaaatcactgtcttggctcgaaac

SEQ ID NO: 157 - DNA, 1443 bp, Artificial Sequence
  Synthetic construct
atggacgccatggccaccaccgagaagaagccccacgtcatcttcatccccttccccgcccagtcccacatcaaggccatgctcaagctcgcccagctcctccaccacaagggcctccagatcacctttgtcaacaccgacttcatccacaaccagttcctcgagtcctccggcccccactgtctggacggtgctcccggtttccgatttgagactatccccgatggtgtctcccactcccccgaggcctccatccccatccgagagtctctgctccgatccattgagactaacttcctcgaccgattcattgatctcgtcaccaagctccccgatcctcccacctgtatcatctccgacggtttcctgtccgttttcaccattgatgctgccaagaagctcggtatccccgtcatgatgtactggactctggctgcctgtggtttcatgggtttctaccacatccactctctgatcgagaagggctttgctcctctcaaggacgcctcctacctcaccaacggttacctcgacaccgtcattgactgggtccccggtatggagggtatccgactcaaggacttccccctcgactggtccaccgacctcaacgacaaggttctcatgttcaccaccgaggctccccagcgatcccacaaggtttcccaccacatcttccacaccttcgacgagctcgagccctccatcatcaagactctgtctctgcgatacaaccacatctacaccattggccccctccagctcctcctcgaccagatccccgaggagaagaagcagaccggtatcacctctctgcacggctactctctcgtcaaggaagagcccgagtgcttccagtggctccagtccaaggagcccaactccgttgtctacgtcaactttggctccaccaccgtcatgtctctcgaggacatgaccgagtttggctggggtctggccaactccaaccactacttcctgtggatcatccgatccaacctcgtcattggcgagaacgccgttctgcctcccgagctcgaggagcacatcaagaagcgaggcttcattgcctcttggtgctcccaggagaaggttctcaagcacccctccgtcggtggtttcctgacccactgcggctggggctccaccattgagtctctgtccgctggtgtccccatgatctgctggccctactcctgggaccagctcaccaactgccgatacatctgcaaggagtgggaggttggtctggagatgggtaccaaggtcaagcgagatgaggtcaagcgactcgtccaggagctcatgggcgagggtggtcacaagatgcgaaacaaggccaaggactggaaggagaaggcccgaattgccattgcccccaacggctcttcttctctcaacattgacaagatggtcaaggagatcactgttctcgctcgaaac

SEQ ID NO: 158 - DNA, 1437 bp, Artificial Sequence
  Synthetic construct
atggacgccgttgccgtcaactccgagactatgtcccacgttgtctttatccccttccccgcccagtcccacatcaagtgcatgctcaagctcgcccgactgctgcaccacaagggtctgcacatcacctttgtcaacaccgagctcaaccacaaccagctgctgtcctccggtggtcccaactctctcgacggtgagcccggtttccgattcaagaccatccccgatggtgtccccgagggtgctcccgacttcatgtacgctctgtgtgactccgttctcaacaagatgctcgaccccttcgtcgatctcattggccgactcgagtcccccgccacctgtatcatcggtgacggtatgatgcccttcactgttgctgctgccgagaagctcaagctccccatcatgcacttctggaccttccccgctgctgccttcctcggctactaccaggcccccaacctcattgagaagggcttcatccctcccaaggacgagtcttggtccaccaacggctacctcgagactgttgtcgactccatctccggtctggagggtttccgaatccgagacatccccgcctacttccgaaccaccgaccccaacgactccgacttcaactacatcattgagtgtgtcaaggccatccgaaaggtttccaacattgttctccacacctttgaggagctcgagtccaccatcatcaaggctctgcagcccatgatcccccacgtctacaccattggccccctcgagctcctcctcaaccccatcaagctcgaagaggagactgagaagctcgatatcaagggctactctctgtggaaggaagatgacgagtgcctcaagtggctcgactccaaggagcccaactccgtcatctacgtcaacttcggctctctcatctccatgtccaaggagcagctcgccgagtttggctggggtctggtcaactccaaccactgcttcctctgggtcatccgacgagatctggttgtcggtgactctgctcctctgcctcccgagctcaaggagcgaatcaacgagcgaggtttcattgcctcttggtgcccccaggagaaggtcctcaagcactcctccgtcggtggtttcctcacccactgtggctggggctccatcatcgagtctctgtccgccggtgtccccatgctctgctggccctacctctgggaccagcccaccaactgccgacaggcctgcaaggagtgggaggtcggtctggagattgagggtaacgtcaacaaggacgaggtcgagcgactcacccgagagctcattggtggtgagaagggcaagcagatgcgatccaaggccctcgagtggaagaagaagattgagattgccaccggccccaagggctcttcttctctcaacgtcgagcgactggccaacgacatcaacatgttctcccgaaat

SEQ ID NO: 159 - DNA, 1446 bp, Artificial Sequence
  Synthetic construct
atgggctccattgtccgagatcacgacaagccccacgttgtctgtgtcccctaccccgcccagggccacgtcaaccccatggtcaagctcgccaagctcctccactacaacgacttccacgtcacctttgtcaacaccgagtacaaccaccgacgactcctcaactcccgaggcccctcttctctcgacggcctccccgacttccgattcgaggccatctccgacggtctgcccccttccgacgccaacgccacccaggatatcccctctctctgtgactccacctccaagaactctctggcccccttccgaaacctgctgctcaagctcaagtcctccgactctctgcctcccgtcacctgtatcatctccgacgcctgcatgtccttcaccctcgatgctgctgaggagttcggtatccccgagatcctcttctggaccccctcttcttgtggtgttctcggctactcccagtaccacactctcattgagaagggtctgactcccctcaaggacgcctcctacctgaccaacggctacctcgagactaccctcgactggatccccggtatgaaggacatccgattccgagatctgccctctttcatccgaaccaccgaccgaaacgacatcatgctcaacttcgttgtccgagagctcgagcgaacctcccgagcctctgctgttgttttcaacaccttctacgcctttgagaaggacgttctcgacgttctgtccaccatgttccctcccatctactccatcggtcccctccagctcctcgtcgaccagatccccattgaccgaaacctcggtaacattggctccaacctgtggaaggagcagcccgagtgcattgactggctcgacaccaaggagcccaactccgttgtctacgtcaactttggctccatcaccgtcatcactccccagcagatgattgagtttgcctggggtctggcctcttccaagaagcccttcctgtggatcatccgacccgatctggtcattggtgagaacgccatgctccccgctgagtttgtctccgagactaaggaccgaggtatgctcgcctcttggggtccccaggagcagatcctcaagcaccccgctgtcggtggtttcctgtcccacatgggctggaactccaccctcgactccatgtccggtggtgtccccatggtctgctggcccttcttcgccgagcagcagaccaactgccgattcgcctgcaccgagtggggtgtcggtatggagattgacaacaacgtcaagcgagatgaggtcaagaagctcgttgaggtcctcatggacggcaagaagggcaaggagatgaagtccaaggccatggagtggaaaaccaaggctgaggaagctgccaagcccggtggttcctcccacaacaacctcgaccgactcgtcaagttcatcaagggccagaagaat

SEQ ID NO: 160 - protein, 473 aa, Artificial Sequence
  Synthetic construct
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 161 - protein, 473 aa, Artificial Sequence; identical to SEQ ID NO: 160
  Synthetic construct

SEQ ID NO: 162 - protein, 459 aa, Artificial Sequence
  Synthetic construct
MGSQATTYHMAMYPWFGVGHLTGFFRLANKLAGKGHRISFLIPKNTQSKLESFNLHPHLISFVPIVVPSIPGLPPGAETTSDVPFPSTHLLMEAMDKTQNDIEIILKDLKVDVVFYDFTHWLPSLARKIGIKSVFYSTISPLMHGYALSPERRVVGKQLTEADMMKAPASFPDPSIKLHAHEARGFTARTVMKFGGDITFFDRIFTAVSESDGLAYSTCREIEGQFCDYIETQFQKPVLLAGPALPVPSKSTMEQKWSDWLGKFKEGSVIYCAFGSECTLRKDKFQELLWGLELTGMPFFAALKPPFETESVEAAIPEELKEKIQGRGIVHGEWVQQQLFLQHPSVGCFVSHCGWASLSEALVNDCQIVLLPQVGDQIINARIMSVSLKVGVEVEKGEEDGVFSRESVCKAVKAVMDEKSEIGREVRGNHDKLRGFLMNADLDSKYMDSFNQKLQDLLG

SEQ ID NO: 163 - protein, 438 aa, Artificial Sequence
  Synthetic construct
MDSKIDSKTFRVVMLPWLAYSHISSFLVFAKRLTNHNFHIYICSSQTNMQYLKNNLTSQYSKSIQLIELNLPSSSELPLQYHTTHGLPPHLTKTLSDDYQKSGPDFETILIKLNPHLVIYDFNQLWAPEVASTLHIPSIQLLSGCVALYALDAHLYTKPLDENLAKFPFPEIYPKNRDIPKGGSKYIERFVDCMRRSCEIILVRSTMELEGKYIDYLSKTLGKKVLPVGPLVQEASLLQDDHIWIMKWLDKKEESSVVFVCFGSEYILSDNEIEDIAYGLELSQVSFVWAIRAKTSALNGFIDRVGDKGLVIDKWVPQANILSHSSTGGFISHCGWSSTMESIRYGVPIIAMPMQFDQPYNARLMETVGAGIEVGRDGEGRLKREEIAAVVRKVVVEDSGESIREKAKELGEIMKKNMEAEVDGIVIENLVKLCEMNN

SEQ ID NO: 164 - protein, 473 aa, Artificial Sequence
  Synthetic construct
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEVPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNTRAVAIDHES

SEQ ID NO: 165 - protein, 485 aa, Artificial Sequence
  Synthetic construct
MYNVTYHQNSKAMATSDSIVDDRKQLHVATFPWLAFGHILPFLQLSKLIAEKGHKVSFLSTTRNIQRLSSHISPLINVVQLTLPRVQELPEDAEATTDVHPEDIQYLKKAVDGLQPEVTRFLEQHSPDWIIYDFTHYWLPSIAASLGISRAYFCVITPWTIAYLAPSSDAMINDSDGRTTVEDLTTPPKWFPFPTKVCWRKHDLARMEPYEAPGISDGYRMGMVFKGSDCLLFKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFCDQPLNARLLEDKQVGIEIPRNEEDGCLTKESVARSLRSVVVENEGEIYKANARALSKIYNDTKVEKEYVSQFVDYLEKNARAVAIDHES

SEQ ID NO: 166 - protein, 473 aa, Artificial Sequence
  Synthetic construct
MATSDSIVDDRKQLHVATFPWLAFGHILPFLQLSKLIAEKGHKVSFLSTTRNIQRLSSHISPLINVVQLTLPRVQELPEDAEATTDVHPEDIQYLKKAVDGLQPEVTRFLEQHSPDWIIYDFTHYWLPSIAASLGISRAYFCVITPWTIAYLAPSSDAMINDSDGRTTVEDLTTPPKWFPFPTKVCWRKHDLARMEPYEAPGISDGYRMGMVFKGSDCLLFKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPLFGDQPLNARLLEDKQVGIEIPRNEEDGCLTKESVARSLRSVVVENEGEIYKANARELSKIYNDTKVEKEYVSQFVDYLEKNARAVAIDHES

SEQ ID NO: 167 - protein, 452 aa, Artificial Sequence
  Synthetic construct
MDEPHELHIAMFPWLAFGHIIPFLELAKLIAQRGHKISFISTPRNIQRLPTIPPNLTPRINLVSLALPHVENLPNNAEATADLPFDKIPYLKIAYDRLQDSLFHFLHSSSPDWIIFDFASYWLPEIATKLGISGVLFSIFGAWTLSFAGPSYSAILNGDDPRTEPQHFTVPPKWVTFPSKVAFRIHEAKRFLVQIEANSSGVTDIFRWGSVLAGCDVIAVRSCLELEADFLRLVEDLHCKPVIPVGLLPPPAQCSEGGSREGGVDEKWVTISEWLDKQTQGSVVYIAFGSELTINQNEITELALGLELSGLPFFWAFRNRDDSVRLPDGFDERVKGRGVVWTSWAPQLRIMAHESVGGFLTHCGYSSVIEALSFGLALIMLPFAIDQGLIARVFEGKKVGIEVPRDEQDGSFTRNSVAESLRLVIVDKEGSAYRENAKQQMVTLFGLTYTMT

SEQ ID NO: 168 - protein, 1419 aa, Artificial Sequence
  Synthetic construct
ATGGCCACTTCTGACTCCATCGTTGATGACAGAAAGCAATTGCACGTTGCTACTTTCCCATGGTTAGCTTTCGGTCACATTTTGCCATACTTGCAATTGTCCAAATTGATTGCTGAAAAGGGTCACAAAGTCTCTTTCTTGTCCACCACCAGAAACATCCAAAGATTATCTTCTCACATTTCTCCATTGATCAACGTTGTCCAATTGACTTTACCAAGAGTTCAAGAATTGCCAGAAGATGCTGAAGCTACCACCGATGTCCATCCAGAAGATATCCCATACTTGAAGAAGGCTTCTGATGGTTTGCAACCAGAAGTCACTAGATTCTTGGAACAACACTCTCCAGACTGGATTATCTACGACTACACTCACTACTGGTTACCATCCATTGCTGCCTCTTTGGGTATCTCTCGTGCTCATTTCTCCGTTACCACTCCATGGGCTATTGCTTACATGGGTCCATCTGCTGATGCTATGATCAACGGTTCTGATGGTAGAACCACTGTCGAAGACTTGACCACTCCACCAAAATGGTTCCCATTCCCAACCAAGGTCTGTTGGAGAAAGCACGATTTGGCCAGATTAGTTCCATACAAGGCCCCAGGTATCTCTGACGGTTACAGAATGGGTTTAGTCTTGAAGGGTTCTGACTGTTTGTTGTCCAAGTGTTACCATGAATTCGGTACTCAATGGTTACCTTTGTTGGAAACTTTGCACCAAGTCCCAGTTGTTCCAGTTGGTTTGTTGCCTCCTGAAATCCCAGGTGACGAAAAGGACGAAACCTGGGTTTCCATCAAGAAATGGTTAGATGGTAAGCAAAAGGGTTCCGTTGTCTACGTTGCTTTGGGTTCTGAAGTCTTGGTTTCTCAAACTGAAGTTGTTGAATTGGCTTTGGGTTTGGAATTGTCCGGTCTACCATTTGTCTGGGCTTACAGAAAGCCAAAGGGTCCAGCTAAGTCTGACTCTGTTGAATTGCCAGATGGTTTCGTCGAAAGAACCAGAGACAGAGGTTTGGTCTGGACTTCCTGGGCTCCACAATTGAGAATTTTGTCCCACGAATCTGTTTGTGGTTTCTTGACCCACTGTGGTTCTGGTTCCATTGTCGAAGGTTTGATGTTCGGTCACCCATTGATCATGTTGCCAATCTTCGGTGACCAACCATTGAACGCTAGATTATTGGAAGACAAGCAAGTCGGTATTGAAATCCCAAGAAACGAAGAAGACGGTTGTTTGACCAAGGAATCTGTTGCCCGTTCTCTAAGATCTGTTGTTGTCGAAAAGGAAGGTGAAATCTACAAGGCTAACGCTAGAGAATTGTCCAAGATCTACAACGATACCAAGGTCGAAAAGGAATATGTCTCCCAATTTGTTGACTACTTGGAAAAGAACGCTCGTGCCGTTGCCATTGACCACGAAAGC

SEQ ID NO: 169 - DNA, 1419 bp, Artificial Sequence
  Synthetic construct
atggctacatctgattctattgttgatgacaggaagcagttgcatgtggctactttcccttggcttgctttcggtcatatactgccttacctacaactatcaaaactgatagctgaaaaaggacataaagtgtcattcctttcaacaactagaaacattcaaagattatcttcccacatatcaccattgattaacgtcgttcaattgacacttccaagagtacaggaattaccagaagatgctgaagctacaacagatgtgcatcctgaagatatcccttacttgaaaaaggcatccgatggattacagcctgaggtcactagattccttgagcaacacagtccagattggatcatatacgactacactcactattggttgccttcaattgcagcatcactaggcatttctagggcacatttcagtgtaaccacaccttgggccattgcttacatgggtccatccgctgatgctatgattaacggcagtgatggtagaactaccgttgaagatttgacaaccccaccaaagtggtttccatttccaactaaagtctgttggagaaaacacgacttagcaagactggttccatacaaggcaccaggaatctcagacggctatagaatgggtttagtccttaaagggtctgactgcctattgtctaagtgttaccatgagtttgggacacaatggctaccacttttggaaacattacaccaagttcctgtcgtaccagttggtctattacctccagaaatccctggtgatgagaaggacgagacttgggtttcaatcaaaaagtggttagacgggaagcaaaaaggctcagtggtatatgtggcactgggttccgaagttttagtatctcaaacagaagttgtggaacttgccttaggtttggaactatctggattgccatttgtctgggcctacagaaaaccaaaaggccctgcaaagtccgattcagttgaattgccagacggctttgtcgagagaactagagatagagggttggtatggacttcatgggctccacaattgagaatcctgagtcacgaatctgtgtgcggtttcctaacacattgtggttctggttctatagttgaaggactgatgtttggtcatccacttatcatgttgccaatctttggtgaccagcctttgaatgcacgtctgttagaagataaacaagttggaattgaaatcccacgtaatgaggaagatggatgtttaaccaaggagtctgtggccagatcattacgttccgttgtcgttgaaaaggaaggcgaaatctacaaggccaatgcccgtgaactttcaaagatctacaatgacacaaaagtagagaaggaatatgtttctcaatttgtagattacctagagaaaaacgctagagccgtagctattgatcatgaatcc

SEQ ID NO: 170 - DNA, 1377 bp, Artificial Sequence
  Synthetic construct
atgggttctcaagctaccacctaccacatggccatgtacccatggttcggtgtcggtcatttgactggtttcttcagattggctaacaagttggctggtaagggtcacagaatctctttcttgattccaaagaacactcaatccaaattggaatctttcaacttgcacccacatttgatctctttcgttccaattgttgttccatccattccaggtctaccaccaggtgctgaaaccacctctgatgtcccattcccatctacccatttgttgatggaagctatggacaagactcaaaacgatattgaaatcatcttgaaggacttgaaggtcgatgtcgttttctacgatttcacccactggttaccatctttggccagaaagatcggtatcaaatccgtcttttactccaccatttctccattgatgcacggttacgctttgtccccagaaagaagagttgtcggtaagcaattgactgaagctgacatgatgaaggctccagcttctttcccagacccatccatcaaattgcacgctcacgaagccagaggtttcaccgccagaaccgttatgaagttcggtggtgatatcactttcttcgatcgtattttcactgctgtttctgaatctgatggtttggcttactccacttgtcgtgaaatcgaaggtcaattctgtgactacattgaaactcaattccaaaagccagtcttattggctggtccagctttgccagttccttccaagtccaccatggaacaaaaatggtctgactggttaggtaagttcaaggaaggttctgtcatttactgtgctttcggttctgaatgtaccttgagaaaggacaaattccaagaactattatggggtttggaattgactggtatgccattctttgctgctttgaagcctccatttgaaactgaatctgttgaagctgccatcccagaagaattgaaggaaaagatccaaggtagaggtatcgttcacggtgaatgggttcaacaacaattgtttttgcaacacccatctgttggttgtttcgtttcccactgtggttgggcttctttgtccgaagctttggtcaatgactgtcaaatcgtcttgttgccacaagtcggtgaccaaattattaacgccagaatcatgtccgtttctttgaaggttggtgttgaagtcgaaaagggtgaagaagatggtgttttctccagagaatctgtctgtaaggccgtcaaggctgtcatggatgaaaagtctgaaatcggtagagaagttagaggtaaccacgacaaattgagaggtttcttgatgaacgctgacttggactccaagtacatggactctttcaaccaaaagttgcaagacttattaggg

SEQ ID NO: 171 - DNA, 1314 bp, Artificial Sequence
  Synthetic construct
atggactctaagattgactccaagactttcagagttgttatgttgccatggttggcttactcccacatctcttctttcttggttttcgctaagagattgaccaaccacaacttccacatctacatctgttcctctcaaaccaacatgcaatacttgaagaacaacttgacttctcaatactccaagtccatccaattgattgaattgaacttgccatcttcttctgaattgccattgcaataccacaccacccacggtctaccacctcatttgaccaagactctatccgatgactaccaaaaatctggtccagacttcgaaaccatcttgatcaaattgaaccctcacttagtcatctacgacttcaaccaattatgggctccagaagttgcttccactttgcacattccatctatccaattgttgtccggttgtgttgctttgtacgctttggatgctcatttgtacaccaagccattggatgaaaacttggccaagttcccattcccagaaatctacccaaagaacagagatatcccaaagggtggttccaaatacatcgaaagatttgtcgactgtatgagaagatcttgtgaaatcatcttggtcagatccactatggaattggaaggtaagtacattgactacttgtctaagactttaggtaagaaggtcttaccagttggtccattagtccaagaagcttctttgttgcaagatgaccacatctggatcatgaaatggttggacaagaaggaagaatcctctgttgtctttgtttgtttcggttctgaatacattttgtctgacaacgaaatcgaagacattgcttacggtttggaattgtctcaagtctctttcgtctgggctatcagagccaagacctctgctttgaatggtttcattgaccgtgttggtgacaagggtttggtcattgacaaatgggttccacaagctaacatcttgtcccactcttccactggtggtttcatctcccactgtggttggtcctctaccatggaatccatcagatacggtgttccaatcattgctatgccaatgcaattcgatcaaccatacaacgccagattgatggaaactgtcggtgctggtattgaagttggtagagatggtgaaggtagattgaagcgtgaagaaattgccgctgttgtcagaaaggttgttgttgaagattctggtgaatctatcagagaaaaggccaaggaattaggtgaaattatgaagaagaacatggaagctgaagtcgatggtattgtcattgaaaacttagtcaaattgtgtgaaatgaacaac

SEQ ID NO: 172 - DNA, 1419 bp, Artificial Sequence
  Synthetic construct
atggccacttctgactctattgtcgatgacagaaagcaattgcacgttgccactttcccatggttggccttcggtcacattttgccatacttgcaattgtccaagttgattgctgaaaagggtcacaaggtttctttcttgtccactaccagaaacatccaaagattatcttctcacatctctccattaatcaacgttgtccaattgactttaccaagagttcaagaattgccagaagatgctgaagctaccaccgatgtccatccagaagatatcccatacttgaagaaggcttctgacggtttgcaacctgaagtcacccgtttcttggaacaacactctccagactggatcatctacgactacactcactactggttaccttccattgctgcttctttgggtatctcccgtgctcatttctccgtcaccactccatgggctattgcttacatgggtccatctgctgatgctatgatcaacggttctgatggtagaaccactgttgaagatttgaccactccaccaaaatggttcccattcccaactaaggtctgttggagaaagcacgatttggccagattggttccatacaaggctccaggtatctctgatggttacagaatgggtttggttttgaaaggttctgactgtttgttgtccaaatgttaccatgaattcggtactcaatggttaccattgttggaaactttgcaccaagttccagttgttccagtcggtctattaccaccagaagtcccaggtgacgaaaaggacgaaacctgggtttccatcaagaaatggttagatggtaagcaaaagggttccgttgtctacgttgctttgggttctgaagtcttggtttctcaaactgaagttgtcgaattggctttaggtttggaattgtccggtttgcctttcgtctgggcttacagaaagccaaagggtccagctaaatctgactccgtcgaattaccagacggtttcgttgaaagaacccgtgacagaggtttggtctggacttcctgggctccacaattgagaatcttgtcccacgaatctgtttgtggtttcttgacccactgtggttctggttccattgtcgaaggtttgatgtttggtcacccattgatcatgttgccaatcttcggtgaccaaccattgaacgccagattattggaagacaagcaagtcggtattgaaattccaagaaacgaagaagatggttgtttgaccaaggaatctgttgccagatctttgagatccgttgttgtcgaaaaggaaggtgaaatctacaaggctaacgctagagaattgtctaagatctacaacgacaccaaggttgaaaaggaatacgtttctcaatttgtcgactacttggaaaagaacaccagagctgttgccattgaccacgaaagt

SEQ ID NO: 173 - DNA, 1455 bp, Artificial Sequence
  Synthetic construct
atgtacaacgtcacctaccatcaaaactccaaggctatggctacttctgactctattgtcgatgacagaaagcaattgcacgttgccactttcccatggttagctttcggtcacatcttaccattcttgcaattgtccaaattgattgctgaaaagggtcacaaggtttctttcttgtctaccactagaaacattcaaagattgtcttcccacatctctccattgatcaacgttgttcaattgactctaccaagagtccaagaattaccagaagatgctgaagctaccaccgatgtccatccagaagatatccaatacttgaagaaggctgttgacggtttgcaaccagaagttaccagattcttggaacaacactctccagactggatcatctacgacttcacccactactggttaccttccattgctgcctccttgggtatctccagagcttacttctgtgttatcactccatggaccattgcttacttggctccatcttctgatgctatgatcaacgactctgacggtagaaccactgtcgaagatttgaccactccacctaaatggttcccattcccaactaaggtctgttggagaaagcatgacttggccagaatggaaccatacgaagctccaggtatctccgatggttacagaatgggtatggttttcaagggttctgactgtttgttgttcaagtgttaccacgaattcggtactcaatggttaccattgttggaaactttgcaccaagtcccagttgtcccagtcggtttgttgccaccagaaatcccaggtgacgaaaaggacgaaacctgggtttccatcaagaaatggttggatggtaagcaaaagggttccgttgtctacgttgccttgggttctgaagctttagtctctcaaactgaagttgttgaattggctttgggtttggaattgtctggtctaccatttgtctgggcttacagaaagccaaagggtccagccaaatctgactccgttgaattgccagatggtttcgtcgaacgtaccagagacagaggtttagtctggacttcctgggctcctcaattgagaatcttgtctcacgaatctgtctgtggtttcttgactcactgtggttctggttccattgtcgaaggtttgatgttcggtcacccattgattatgttgccaattttctgtgaccaaccattgaacgctagattattggaagacaaacaagtcggtattgaaatcccaagaaacgaagaagatggttgtttgaccaaggaatctgttgctcgttctttgagatctgttgttgtcgaaaacgaaggtgaaatctacaaggccaatgctcgtgctttgtccaagatctacaacgataccaaggttgaaaaggaatacgtttctcaatttgttgactacttggaaaagaacgccagagctgttgccattgaccacgaatcc

SEQ ID NO: 174 - DNA, 1419 bp, Artificial Sequence
  Synthetic construct
atggccacttctgactccattgttgatgacagaaagcaattgcacgttgctactttcccatggttggcctttggtcacattttgcctttcttgcaattgtctaaattgattgctgaaaagggtcacaaggtttccttcttgtctaccaccagaaacatccaaagattatcttcccacatctctcctttgatcaacgttgttcaattgactctaccacgtgtccaagaattaccagaagacgctgaagctactaccgatgtccacccagaagatatccaatacttgaagaaggctgtcgatggtttgcaaccagaagtcaccagattcttggaacaacactctccagactggatcatctacgacttcactcactactggttgccatccattgctgcttctttgggtatctccagagcttacttctgtgtcatcactccatggaccattgcttacttggctccatcttctgatgctatgattaacgattctgatggtagaaccaccgtcgaagacttgaccactccaccaaaatggttcccattcccaaccaaggtctgttggagaaagcacgacttggccagaatggaaccatacgaagctccaggtatctccgatggttacagaatgggtatggttttcaagggttccgactgtctattattcaaatgttaccatgaatttggtactcaatggttaccattgttggaaactttgcaccaagtcccagttgttccagttggtttgttgcctccagaaatcccaggtgatgaaaaggacgaaacctgggtttccatcaagaaatggttggacggtaagcaaaagggttctgttgtctacgttgctttgggttctgaagctttggtttctcaaactgaagttgtcgaattggctttaggtttggaattgtccggtttgccattcgtctgggcttacagaaagccaaagggtccagctaagtctgactctgttgaattgccagatggtttcgttgaaagaaccagagacagaggtttggtctggacttcttgggctccacaattgagaattttgtcccacgaatctgtctgtggtttcttgactcactgtggttctggttccattgtcgaaggtttgatgttcggtcatccattgatcatgttgccattattcggtgaccaaccattgaacgctagattattggaagacaaacaagtcggtattgaaattccaagaaacgaagaagatggttgtttgaccaaggaatccgttgctcgttctttacgttctgtcgttgtcgaaaacgaaggtgaaatctacaaggccaatgccagagaattgtccaagatctacaacgacaccaaggttgaaaaggaatacgtttctcaatttgtcgactacttggaaaagaacgccagagctgttgccatcgaccacgaatcc

SEQ ID NO: 175 - DNA, 1356 bp, Artificial Sequence
  Synthetic construct
atggacgaacctcacgaattgcacattgctatgttcccatggttggcctttggtcacatcattccattcttggaattagccaagttgattgctcaaagaggtcacaagatctctttcatctccactccaagaaacatccaaagattaccaaccatcccaccaaacttgaccccaagaatcaacttagtctctttggctttgccacacgttgaaaacttgccaaacaacgctgaagccactgctgacttgccattcgacaagatcccatacttgaagattgcttacgacagattgcaagactctttgttccatttcttgcactcttcttctccagactggatcatcttcgattttgcctcctactggttaccagaaattgctaccaaattgggtatctccggtgttttgttctccatcttcggtgcttggactttatctttcgctggtccatcttactctgccattttgaacggtgatgacccaagaaccgaaccacaacatttcaccgttccaccaaaatgggtcactttcccatccaaggttgctttccgtatccacgaagctaagagattcttggttcaaatcgaagctaactcttctggtgtcactgacatcttcagatggggttccgttttggctggttgtgatgtcattgccgtcagatcttgtttggaattggaagctgacttcttgagattggtcgaagatttgcactgtaagccagttatcccagtcggtctattaccacctccagctcaatgttctgaaggtggttccagagaaggtggtgtcgacgaaaaatgggttaccatttctgaatggttggacaagcaaactcaaggttccgttgtctacattgctttcggttctgaattgaccatcaaccaaaatgaaatcactgaattggctttgggtttagaattgtctggtttgccattcttctgggctttcagaaacagagatgactccgttagattgccagatggtttcgatgaaagagtcaagggtcgtggtgttgtctggacttcctgggctcctcaattgagaatcatggctcacgaatccgttggtggtttcttgactcactgtggttactcctctgttatcgaagctttgtccttcggtttggctttaatcatgttgccatttgccattgaccaaggtttgattgcccgtgttttcgaaggtaagaaggtcggtattgaagtcccaagagatgaacaagatggttccttcaccagaaactctgttgctgaatctctaagattggtcattgttgacaaggaaggttctgcttacagagaaaacgctaagcaacaaatggttactttgtttggtttgacctacaccatgacg

SEQ ID NO: 176 - DNA, 1419 bp, Artificial Sequence
  Synthetic construct
atggccacctccgactccattgtcgacgaccgaaagcagctgcacgttgccaccttcccctggctcgcctttggccacattctgccctacctccagctctccaagctcattgctgagaagggccacaaggtttctttcctgtccaccacccgaaacatccagcgactctcctcccacatctctcctctcatcaacgttgtccagctcaccctcccccgagtccaggagctccccgaggatgccgaggccaccactgatgtccaccccgaggacatcccctacctcaagaaggcctccgacggtctgcagcccgaggtcacccgattcctcgagcagcactctcccgactggatcatctacgactacacccactactggctcccctccattgctgcttctctcggtatctctcgagcccacttctccgtcaccaccccctgggccattgcttacatgggcccctctgctgacgccatgatcaacggttccgacggccgaaccaccgtcgaggatctcaccacccctcccaagtggttccccttccccaccaaggtctgctggcgaaagcacgatctcgcccgactcgtcccctacaaggcccccggtatctccgacggttaccgaatgggtctggttctcaagggctccgactgtctgctctccaagtgctaccacgagtttggtacccagtggctccccctgctcgagactctgcaccaggtccccgttgtccccgtcggtctgctccctcccgagatccccggtgacgagaaggacgagacttgggtttccatcaagaagtggctcgacggcaagcagaagggctccgtcgtctacgttgctctcggctccgaggttcttgtctcccagactgaggtcgtcgagctcgccctcggtctggagctctccggtctgcccttcgtctgggcctaccgaaagcccaagggtcccgccaagtccgactccgtcgagctccccgacggtttcgtcgagcgaactcgagatcgaggtctggtctggacctcttgggctccccagctccgaatcctctcccacgagtccgtctgcggtttcctgacccactgtggttccggctccattgtcgagggcctcatgttcggccaccccctcatcatgctgcccatcttcggtgaccagcccctcaacgcccgactcctcgaggacaagcaggtcggtatcgagatcccccgaaacgaagaggacggctgcctcaccaaggagtctgttgcccgatctctgcgatctgttgttgtcgagaaagagggtgagatctacaaggccaacgcccgagagctctccaagatctacaacgacaccaaggtcgagaaggagtacgtttcccagtttgtcgactacctcgagaagaacgcccgagctgtcgccattgaccacgagagt

SEQ ID NO: 177 - protein, 458 aa, Artificial Sequence
  Synthetic construct
MAEEHNKTNNSSPHVVIFPFPSQGHINPLIQFAKRLSSKGVKPTLITTIYIAKTSPYPNSSIVVEPISDGFDDGGFKSATSAESYIDTFHQVGSKSLANLIRKLVNEGNHVDAIIYDSFVTWALDVAMEYGIDGGCFFTQACAVNNIYYHVYKGVLEIPLQAAAPPTVTILLPELPQLQLWETPSFVHNPGPYPGWAHIVFNQFPNIHNARWVFSNTFFKLEEQVIKWMRLMWPLMVVGPTVPSMYLDKRLEDDDDYGMSLLKPNHIECMGWLNNKPKGSVVYVSFGSYGELGVAQMEEIAWGLNESSVNYLWVVRETEKEKLPKSFLANGLIVEWCRQLEVLAHEAVGCFVTHCGFNSSLETISLGVPVVAIPQWTDQTTNAKCLEDIWGVGIRAKTPVTRTNLVWCIKEIMEGERGAVARKNAIKWKDLAIEAVSPGGSSDKDINEFVSQLSPIKC

SEQ ID NO: 178 - protein, 454 aa, Artificial Sequence
  Synthetic construct
MDNKKSHVIVLTYPAQGHINPLLQFAKRLASKGLKATLATTYYTVNSIDAPTVGVEPISDGFDEGGFKQASSLDVYLESFKTVGSRTLTELVFKFKASGSPVNCVVYDSMLPWALDVARDLGIYAAAFMTTSASVCSMYWRIDLGLLSLPLKQQTATVSLPGLPPLGCCDLPSFLAEPTSQTAYLEVIMEKFHSLNEDDWVFCNSFEDLEIELVKAMRGKWPLVMVGPMVPSAYLDQQIDGDRAYGASLWKPTSSQCFTWLDTKPPRSVIYVSFGSMGNISAEQVEEIAWGLKASNRPFLWVMKESEKKLPTGFLNSVGETGMVVSWCNQLEVLAHQAIGCFVTHCGWNSTLEGLGLGVPMVCVTERSDQPMNAKFVEDVWKVGVRAKKDEVGIVTREELEKCIRGVMDGENGEEIKRNANKWRELARSAVSVGGSSDMNINEFVVKLLEGKKG

SEQ ID NO: 179 - protein, 459 aa, Artificial Sequence
  Synthetic construct
MTTQKAHCLILPYPAQGHINPMLQFSKRLQSKGVKITIAATKSFLKTMQELSTSVSVEAISDGYDDGGREQAGTFVAYITRFKEVGSDTLSQLIGKLTNCGCPVSCIVYDPFLPWAVEVGNNFGVATAAFFTQSCAVDNIYYHVHKGVLKLPPTDVDKEISIPGLLTIEASDVPSFVSNPESSRILEMLVNQFSNLENTDWVLINSFYELEKEVIDWMAKIYPIKTIGPTIPSMYLDKRLPDDKEYGLSVFKPMTNACLNWLNHQPVSSVVYVSFGSLAKLEAEQMEELAWGLSNSNKNFLWVVRSTEESKLPNNFLEELASEKGLVVSWCPQLQVLEHKSIGCFLTHCGWNSTLEAISLGVPMIAMPHWSDQPTNAKLVEDVWEMGIRPKQDEKGLVRREVIEECIKIVMEEKKGKKIRENAKKWKELARKAVDEGGSSDRNIEEFVSKLVTIASVES

SEQ ID NO: 180 - protein, 478 aa, Artificial Sequence
  Synthetic construct
MSNNENNATQVIVLPYHGQGHMNTMVQFAKRLAWKGVHVTIATTFNTIQQMKLNISSYNSITLEPIYDDTDDSTLHIKDRMARFEAEAASNLTRVLEAKKQQQALNKKCLLVYHGSLNWALVVAHQQNVAGAAFFTAASASFACYYYLHLESQGKGVDLEELPSILPPPKVIVQKLPKSFLAYGDNNSHNNNNNNNNNNNNNNMGLHPLVLWLLKDYGNSVKADFVLLNSFDKLEEEAIKWISNICSVKTIGPTIPSTYLDKQIENDVDYGFNQYKPTNEDCMKWLDTKEANSVVYIAFGSVARLSVEQMAEIAKALDHSSKSFIWVVRETEKEKLPVDLVEKISGQGMVVPWAPQLEVLAHDAVGCFVSHCGWNSTIEALSFGVPILAMPQFLDQLVDAHFVDRVWGVGIAPTVDENDLVTQEEISRCLDEMMGGGPEGEKIKKNVAMWKELTKEALDKGGSSDKHIDEIIEWLSSS

SEQ ID NO: 181 - protein, 481 aa, Artificial Sequence
  Synthetic construct
MPIINKTMLITYADSLGKNLKELNENIENYFGDAVGGVHLLPFFPSTGDRGFAPIDYHEVDSAFGDWDDVKCLGEKYYLMFDFMINHISRQSKYYKDYQEKHEASAYKDLFLNWDKFWPKNRPTQEDVDLIYKRKDRAPKQEIQFADGSVEHLWNTFGEEQIDLDVTKEVTMDFIRSTIENLAANGCDLIRLDAFAYAVKKLDTNDFFVEPEIWTLLDKVRDIAAVSGAEILPEIHEHYTIQFKIADHDYYVYDFALPMVTLYSLYSSKVDRLAKWLKMSPMKQFTTLDTHDGIGVVDVKDILTDEEITYTSNELYKVGANVNRKYSTAEYNNLDIYQINSTYYSALGDDDQKYFLARLIQAFAPGIPQVYYVGFLAGKNDLELLESTKEGRNINRHYYSSEEIAKEVKRPVVKALLNLFTYRNQSAAFDLDGRIEVETPNEATIVIERQNKDGSHIAKAEINLQDMTYRVTENDQTISFE

SEQ ID NO: 182 - protein, 460 aa, Artificial Sequence
  Synthetic construct
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 183 - DNA, 1374 bp, Artificial Sequence
  Synthhtic construct
atggctgaagaacacaacaagaccaacaactcttctcctcacgttgtcatcttcccattcccatctcaaggtcacattaacccattgattcaatttgccaagagattgtcctccaagggtgtcaagccaactttgatcactaccatctacattgctaagacctctccatacccaaactcttccattgttgttgaaccaatttctgatggtttcgacgacggtggtttcaagtctgccacttctgctgaatcttacattgacactttccaccaagttggttccaaatctctagctaacttgatcagaaagttggtcaacgaaggtaaccatgtcgatgctatcatctacgactctttcgtcacctgggctttggatgttgctatggaatacggtattgacggtggttgtttcttcacccaagcttgtgctgtcaacaacatctactaccatgtttacaagggtgtcttggaaattccattgcaagctgctgctccaccaaccgtcactatcttattgcctgaattgcctcaattacaattatgggaaactccatcctttgtccacaacccaggtccatacccaggttgggctcacattgttttcaaccaattcccaaacatccacaacgccagatgggttttctccaacactttcttcaaattggaagaacaagttatcaaatggatgagattgatgtggccattgatggttgtcggtccaactgttccatccatgtacttggacaagagattagaagatgacgatgactacggtatgtctttgttgaagccaaaccacattgaatgtatgggttggttgaataacaaaccaaagggttccgttgtctacgtttccttcggttcctacggtgaattaggtgttgctcaaatggaagaaattgcttggggtttgaacgaatcttccgtcaactatttatgggttgtcagagaaactgaaaaggaaaagttgccaaagtctttcttggctaatggtttgattgttgaatggtgtcgtcaattggaagttttggctcacgaagctgtcggttgtttcgtcactcactgtggtttcaactcctctttggaaaccatctctttgggtgtcccagttgttgccatcccacaatggaccgatcaaaccaccaacgctaagtgtttggaagatatctggggtgttggtatcagagccaagactccagtcaccagaaccaacttggtctggtgtatcaaggaaatcatggaaggtgaacgtggtgctgttgctagaaagaacgccatcaagtggaaggacttggccattgaagctgtctctccaggtggttcctctgacaaggacatcaacgaatttgtttctcaattgtctccaatcaaatgt

SEQ ID NO: 184 - DNA, 1362 bp, Artificial Sequence
  Synthetic construct
atggacaacaagaagtctcatgtcattgtcttgacctacccagctcaaggtcacatcaacccattgttgcaattcgccaagagattagcttccaagggtttgaaggccactttggctaccacctactacactgttaactccattgacgctccaactgtcggtgttgaaccaatctctgatggtttcgatgaaggtggtttcaagcaagcttcctctctagatgtctacttggaatctttcaagaccgtcggttccagaaccttgactgaattagtctttaaattcaaggcttctggttctcctgttaactgtgttgtttacgactccatgttgccatgggctttggacgttgccagagatttgggtatctacgctgctgccttcatgaccacctctgcttccgtctgttccatgtactggagaattgacttaggtttattgtctttgccattgaagcaacaaaccgctaccgtttctttgccaggtttgccaccattgggttgttgtgatttgccatctttcttagctgaaccaacttctcaaactgcttacttggaagttatcatggaaaagttccactccttgaacgaagatgactgggttttctgtaactctttcgaagatttggaaattgaattggtcaaggctatgagaggtaaatggccattggttatggttggtccaatggttccatctgcctacttggaccaacaaattgatggtgaccgtgcctacggtgcttctttgtggaaaccaacttcttctcaatgtttcacctggttggacactaagcctccaagatctgtcatctacgtttcctttggttccatgggtaacatctccgctgaacaagttgaagaaattgcttggggtttgaaggcttccaacagaccattcttatgggttatgaaggaatctgaaaagaaattgccaactggtttcttgaactctgtcggtgaaaccggtatggttgtttcctggtgtaaccaattggaagtcttggctcaccaagctatcggttgtttcgtcacccactgtggttggaactccactttggaaggtttgggtttaggtgttccaatggtttgtgttactgaaagatctgaccaaccaatgaacgctaagttcgttgaagatgtctggaaggtcggtgtcagagctaagaaggacgaagttggtattgtcactagagaagaattggaaaagtgtatcagaggtgtcatggacggtgaaaacggtgaagaaatcaagagaaacgccaacaaatggagagaattagctcgttctgccgtttccgtcggtggttcttctgacatgaacatcaatgaatttgttgtcaaattgttggaaggtaagaagggg

SEQ ID NO: 185 - DNA, 1377 bp, Artificial Sequence
  Synthetic construct
atgaccactcaaaaggctcactgtttgatcttaccatacccagctcaaggtcacatcaacccaatgttgcaattttccaagagattacaatctaagggtgtcaagatcaccattgctgctaccaagtctttcttaaagaccatgcaagaattgtccacttctgtctctgttgaagctatctctgatggttacgatgacggtggtagagaacaagctggtactttcgttgcttacatcaccagattcaaggaagttggttctgacactctatcccaattaatcggtaagttgaccaactgtggttgtccagtttcttgtatcgtctacgatcctttcttgccatgggctgtcgaagtcggtaacaactttggtgttgccactgctgctttcttcactcaatcttgtgctgttgacaacatctactaccatgtccacaaaggtgttttgaaattgccaccaactgatgttgacaaggaaatttccattccaggtttgttgaccattgaagcttctgatgttccatctttcgtttccaacccagaatcttccagaatcttggaaatgttggtcaaccaattctccaatttggaaaacactgactgggttttgatcaactctttctacgaattggaaaaggaagtcattgactggatggccaagatctacccaatcaagaccattggtccaaccattccatccatgtacttggacaaaagattaccagatgacaaggaatacggtttgtccgtctttaaaccaatgaccaatgcttgtttgaactggttgaaccaccaaccagtttcttccgttgtctacgtttctttcggttctttggctaagttggaagctgaacaaatggaagaattggcttggggtttgtccaactccaacaagaacttcttatgggttgtcagatctactgaagaatccaaattgccaaacaacttcttggaagaattggcttctgaaaagggtttggttgtttcctggtgtccacaattacaagttttggaacacaagtccatcggttgtttcttgactcactgtggttggaactctactttggaagccatctctttgggtgttccaatgattgccatgcctcactggtctgaccaaccaaccaacgccaagttggtcgaagatgtctgggaaatgggtatcagaccaaagcaagatgaaaagggtttagtccgtcgtgaagtcattgaagaatgtatcaagattgtcatggaagaaaagaagggtaagaagatcagagaaaacgccaagaaatggaaggaattggccagaaaggctgttgacgaaggtggttcttctgacagaaacattgaagaattcgtttccaaattggtcaccattgcttctgtcgagagt

SEQ ID NO: 186 - DNA, 1434 bp, Artificial Sequence
  Synthetic construct
atgtccaacaatgaaaacaatgccactcaagttatcgttttgccataccacggtcaaggtcacatgaacaccatggttcaatttgccaagagattagcttggaagggtgtccacgtcaccattgctaccactttcaacactatccaacaaatgaaattgaacatttcttcttacaactccatcactttggaaccaatctacgatgacactgatgactccactttgcacatcaaggacagaatggccagatttgaagctgaagccgcttccaatttgaccagagttttggaagccaagaaacaacaacaagctttaaacaagaagtgtttgttggtttaccacggttctttgaactgggctttagtcgttgctcaccaacaaaacgttgctggtgctgctttcttcaccgctgcttctgcttctttcgcttgttactactacttgcatttggaatctcaaggtaagggtgtcgacttggaagaattaccatccatcttaccaccaccaaaggtcattgttcaaaagttgccaaagtctttcttagcttacggtgacaacaactctcacaacaacaacaacaacaacaacaacaacaacaacaacaacaacatgggtttgcacccattggtcttgtggttgttgaaagattacggtaactccgtcaaggctgacttcgttttgttgaactctttcgacaaattggaagaagaagctatcaaatggatctctaacatctgttccgtcaagactatcggtccaaccattccatctacctacttggacaagcaaattgaaaacgatgttgactacggtttcaaccaatacaagccaaccaatgaagattgtatgaaatggttggacaccaaggaagccaactccgttgtctacatcgccttcggttctgttgctcgtttgtctgtcgaacaaatggctgaaattgctaaggctttggaccattcttccaagtctttcatctgggttgtcagagaaactgaaaaggaaaagttgccagtcgatttggttgaaaagatctctggtcaaggtatggttgtcccatgggctcctcaattggaagttttggctcacgatgctgtcggttgtttcgtttctcactgtggttggaactccaccattgaagctttgtctttcggtgttccaattttggccatgcctcaattcttagatcaattggtcgatgctcatttcgttgacagagtctggggtgtcggtattgctccaactgtcgatgaaaacgatttggttactcaagaagaaatctccagatgtctagacgaaatgatgggtggtggtccagaaggtgaaaagatcaagaagaacgttgccatgtggaaggaattgaccaaggaagctttggacaagggtggttcctctgacaagcacattgacgaaatcattgaatggttatcttcctcc

SEQ ID NO: 187 - DNA, 1443 bp, Artificial Sequence
  Synthetic construct
atgccaatcatcaacaagaccatgttgatcacttacgctgactctctaggtaagaacttgaaagaattgaatgaaaacattgaaaactacttcggtgatgctgtcggtggtgttcacttgttgcctttcttcccatccaccggtgacagaggtttcgctccaattgactaccatgaagtcgactccgccttcggtgactgggatgacgttaagtgtttgggtgaaaagtactacttgatgtttgacttcatgatcaaccacatctccagacaatctaagtactacaaggactaccaagaaaagcacgaagcttctgcttacaaggatttgttcttgaactgggacaaattctggccaaagaacagaccaactcaagaagatgtcgacttgatctacaagagaaaggaccgtgccccaaagcaagaaatccaatttgccgatggttctgttgaacacttatggaacactttcggtgaagaacaaatcgatttggatgtcaccaaggaagttaccatggacttcatcagatccaccattgaaaacttggctgctaacggttgtgacttgatcagattggatgctttcgcttacgctgttaagaagctagacaccaacgatttcttcgtcgaaccagaaatctggactttgttggacaaggtccgtgacattgctgctgtttctggtgctgaaattttgccagaaattcacgaacattacactatccaattcaagattgctgaccacgactactacgtttacgactttgctttgccaatggttactttatactctttgtactcctccaaggtcgacagattagctaaatggttgaaaatgtctccaatgaagcaattcaccactttggacacccacgacggtattggtgttgtcgatgtcaaggatatcttgaccgatgaagaaatcacttacacttccaatgaattatacaaggtcggtgccaacgttaacagaaaatactctactgctgaatacaacaacttggatatctaccaaatcaactctacctactactctgctttgggtgacgatgaccaaaagtatttcttggccagattaatccaagctttcgctccaggtatcccacaagtctactacgttggtttcttggccggtaagaacgatttggaattgttggaatccaccaaggaaggtagaaacatcaacagacactactactcttctgaagaaattgctaaggaagtcaaaagaccagttgttaaggctttgttgaacttattcacttacagaaaccaatctgctgcctttgacttggatggtagaattgaagttgaaaccccaaacgaagctaccattgttattgaaagacaaaacaaagatggttcccacattgccaaggctgaaatcaacttgcaagacatgacttaccgtgtcactgaaaacgaccaaaccatttctttcgaa

SEQ ID NO: 188 - DNA, 1434 bp, Artificial Sequence
  Synthetic construct
atgtccaacaacgagaacaacgccacccaggtcattgttctgccctaccacggccagggccacatgaacaccatggtccagtttgccaagcgactcgcctggaagggtgtccacgtcaccatcgccaccaccttcaacaccatccagcagatgaagctcaacatctcctcttacaactccatcactctcgagcccatctacgacgacaccgacgactccactctgcacatcaaggaccgaatggcccgattcgaggctgaggctgcctccaacctgacccgagttctcgaggccaagaagcagcagcaggctctcaacaagaagtgtctgctcgtctaccacggctctctcaactgggccctcgttgtcgcccaccagcagaacgttgccggtgctgccttcttcaccgccgcctctgcttctttcgcctgctactactacctgcacctcgagtcccagggcaagggtgtcgatctcgaggagctcccctccattctgccccctcccaaggtcatcgtccagaagctccccaagtccttcctggcctacggtgacaacaactcccacaacaacaacaataacaacaataacaacaacaataacaacaacatgggtctgcaccctctggttctgtggctcctcaaggactacggcaactccgtcaaggccgactttgtcctcctcaactccttcgacaagctcgaggaagaggccatcaagtggatctccaacatctgctccgtcaagaccatcggtcccaccatcccctccacctacctcgacaagcagatcgagaacgatgtcgactacggtttcaaccagtacaagcccaccaacgaggactgcatgaagtggctcgacaccaaggaagccaactccgttgtctacattgccttcggctctgttgctcgactgtccgtcgagcagatggccgagattgccaaggctctcgaccactcctccaagtctttcatctgggttgtccgagagactgagaaggagaagctccccgtcgacctcgtcgagaagatctccggccagggtatggttgtcccctgggctccccagctcgaggtcctcgcccacgatgctgtcggctgtttcgtttcccactgtggctggaactccaccattgaggctctgtctttcggtgtccccatcctcgccatgccccagttcctcgaccagctcgttgatgcccactttgtcgaccgagtctggggtgtcggtattgcccccactgtcgacgagaacgatctcgtcacccaggaagagatctcccgatgcctcgacgagatgatgggtggtggtcccgagggtgagaagatcaagaagaacgttgccatgtggaaggagctgaccaaagaggctctcgacaagggtggctcttccgacaagcacattgacgagatcattgagtggctctcttctagt

SEQ ID NO: 189 - DNA, 1380 bp, Artificial Sequence
  Synthetic construct
atggccgagcagcagaagatcaagaagtctccccacgttctgctcatccccttccctctgcagggccacatcaaccccttcatccagttcggcaagcgactcatctccaagggtgtcaagaccactctggtcaccaccatccacaccctcaactccactctcaaccactccaacaccaccaccacctccatcgagatccaggccatctccgacggctgtgacgagggtggtttcatgtctgctggtgagtcttacctcgagactttcaagcaggtcggttccaagtctctggctgacctcatcaagaagctccagtccgagggtaccaccattgacgccatcatctacgactccatgaccgagtgggttctcgatgtcgccatcgagtttggtattgacggtggctccttcttcacccaggcctgtgtcgtcaactctctctactaccacgtccacaagggtctgatctctctgcccctcggcgagactgtctccgtccccggtttccccgttctgcagcgatgggagactcctctcattctccagaaccacgagcagatccagtccccctggtcccagatgctcttcggccagttcgccaacattgaccaggcccgatgggttttcaccaactccttctacaagctcgaggaagaggtcattgagtggacccgaaagatctggaacctcaaggtcattggccccaccctcccctccatgtacctcgacaagcgactcgatgacgacaaggacaacggtttcaacctctacaaggccaaccaccacgagtgcatgaactggctcgacgacaagcccaaggagtccgttgtctacgttgcctttggctctctggtcaagcacggccccgagcaggttgaggagatcacccgagctctgattgactccgatgtcaacttcctgtgggtcatcaagcacaaggaagagggtaagctccccgagaacctgtccgaggtcatcaagaccggcaagggcctcattgttgcctggtgcaagcagctcgacgttctcgcccacgagtccgtcggctgctttgtcacccactgcggtttcaactccaccctcgaggctatctctctcggtgtccccgttgttgccatgccccagttctccgaccagaccaccaacgccaagctcctcgatgagattctcggtgtcggtgtccgagtcaaggctgacgagaacggtattgtccgacgaggtaacctggcttcttgtatcaagatgatcatggaggaagagcgaggtgtcatcatccgaaagaacgccgtcaagtggaaggatctggccaaggttgctgtccacgagggtggctcttccgacaacgacattgtcgagtttgtctccgagctcatcaaggcc

SEQ ID NO: 190 - DNA, 1374 bp, Artificial Sequence
  Synthetic construct
atggccgaggagcacaacaagaccaacaactcctctccccacgttgtcatcttccccttcccctcccagggccacatcaaccccctcatccagtttgccaagcgactctcctccaagggtgtcaagcccactctcatcaccaccatctacattgccaagacctctccttaccccaactcctccattgttgtcgagcccatctccgacggtttcgacgacggtggtttcaagtccgccacctccgctgagtcctacattgacaccttccaccaggtcggctccaagtctctggccaacctcatccgaaagctcgtcaacgagggcaaccacgttgatgccatcatctacgactccttcgtcacctgggctctcgatgttgccatggagtacggtattgacggtggctgcttcttcacccaggcctgtgccgtcaacaacatctactaccacgtctacaagggtgtcctcgagatccccctgcaggctgctgctcctcccaccgtcaccattctgctccccgagctcccccagctccagctgtgggagactccctcttttgtccacaaccccggcccctaccccggctgggcccacattgtctttaaccagttccccaacatccacaacgcccgatgggttttctccaacaccttcttcaagctcgaggagcaggtcatcaagtggatgcgactcatgtggcctctcatggtcgtcggtcccaccgtcccctccatgtacctcgacaagcgactcgaggacgacgacgactacggtatgtctctgctcaagcccaaccacattgagtgcatgggctggctcaacaacaagcccaagggctccgtcgtctacgtttctttcggctcttacggtgagctcggtgttgcccagatggaggagattgcctggggtctgaacgagtcctccgtcaactacctgtgggttgtccgagagactgagaaggagaagctccccaagtccttcctggccaacggtctgattgtcgagtggtgccgacagctcgaggtcctcgcccacgaggctgttggctgtttcgtcacccactgcggtttcaactcctctctcgagactatctctctcggtgtccccgttgttgccatcccccagtggaccgaccagaccaccaacgccaagtgcctcgaggatatctggggtgtcggtatccgagccaagacccccgtcacccgaaccaacctggtctggtgcatcaaggagatcatggagggtgagcgaggtgctgttgctcgaaagaacgccatcaagtggaaggatctggccattgaggctgtctcccccggcggctcttccgacaaggacatcaacgagtttgtctcccagctctcccccatcaagtgt

SEQ ID NO: 191 - DNA, 1362 bp, Artificial Sequence
  Synthetic construct
atggacaacaagaagtcccacgtcattgttctgacctaccccgcccagggccacatcaaccccctgctccagtttgccaagcgactcgcctccaagggcctcaaggccactctggccaccacctactacaccgtcaactccatcgacgcccccaccgtcggtgttgagcccatctccgacggtttcgacgagggtggtttcaagcaggcttcttctctcgatgtctacctcgagtccttcaagaccgtcggctcccgaactctgaccgagctcgttttcaagttcaaggcttccggctctcccgtcaactgtgttgtctacgactccatgctcccctgggccctcgacgttgctcgagatctcggtatctacgctgctgccttcatgaccacctctgcttccgtctgctccatgtactggcgaatcgatctcggtctgctgtctctgcccctcaagcagcagaccgccactgtctctctgcccggtctgccccctctcggctgctgtgacctcccctctttcctcgccgagcccacctcccagaccgcctacctcgaggtcatcatggagaagttccactctctcaacgaggacgactgggttttctgcaactccttcgaggacctcgagattgagctcgtcaaggccatgcgaggcaagtggcccctcgtcatggtcggccccatggtcccctccgcctacctcgaccagcagatcgacggtgaccgagcctacggtgcttctctgtggaagcccacctcctcccagtgcttcacctggctcgacaccaagccccctcgatccgtcatctacgtttccttcggctccatgggcaacatctccgccgagcaggttgaggagattgcctggggcctcaaggcttccaaccgacccttcctgtgggtcatgaaggagtccgagaagaagctccccaccggtttcctcaactccgtcggtgagactggtatggttgtctcttggtgcaaccagctcgaggttctcgcccaccaggccattggctgctttgtcacccactgtggctggaactccactctcgagggtctgggcctcggtgtccccatggtctgtgtcaccgagcgatccgaccagcccatgaacgccaagttcgtcgaggatgtctggaaggtcggtgtccgagccaagaaggacgaggttggtattgtcacccgagaggagctcgagaagtgcatccgaggtgtcatggacggtgagaacggtgaggagatcaagcgaaacgccaacaagtggcgagagctcgcccgatctgctgtttccgtcggtggttcctccgacatgaacatcaacgagtttgttgtcaagctgctcgagggcaagaaggga

SEQ ID NO: 192 - DNA, 1377 bp, Artificial Sequence
  Synthetic construct
atgaccacccagaaggcccactgtctgatcctcccctaccccgcccagggccacatcaaccccatgctccagttctccaagcgactccagtccaagggtgtcaagatcaccattgctgccaccaagtctttcctcaagaccatgcaggagctgtccacctctgtctccgtcgaggccatctccgacggctacgacgacggtggccgagagcaggctggtacctttgtcgcctacatcacccgattcaaagaggttggctccgacactctgtcccagctcatcggtaagctcaccaactgtggctgccctgtctcttgcattgtctacgaccccttcctgccctgggctgtcgaggtcggtaacaacttcggtgttgccactgctgccttcttcacccagtcttgtgccgtcgacaacatctactaccacgtccacaagggtgttctcaagctccctcccaccgacgttgacaaggagatctccatccccggtctgctcaccattgaggcttccgatgtcccctcttttgtctccaaccccgagtcctcccgaatcctcgagatgctcgtcaaccagttctccaacctcgagaacaccgactgggttctcatcaactccttctacgagctcgagaaggaagtcattgactggatggccaagatctaccccatcaagaccattggccccaccatcccctccatgtacctcgacaagcgactccccgatgacaaggagtacggtctgtccgtctttaagcccatgaccaacgcctgcctcaactggctcaaccaccagcccgtttcttccgtcgtctacgtttctttcggctctctggccaagctcgaggctgagcagatggaggagctcgcctggggtctgtccaactccaacaagaacttcctgtgggttgtccgatccactgaggagtccaagctccccaacaacttcctcgaggagctcgcctccgagaagggtctggttgtctcttggtgcccccagctccaggttctcgagcacaagtccatcggttgcttcctgacccactgcggctggaactccactctcgaggccatctctctcggtgtccccatgattgccatgccccactggtccgaccagcccaccaacgccaagctcgtcgaggatgtctgggagatgggtatccgacccaagcaggatgagaagggtctggtccgacgagaggtcattgaggagtgtatcaagattgtcatggaggagaagaagggcaagaagatccgagagaacgccaagaagtggaaggagctcgcccgaaaggctgttgacgagggtggctcttccgaccgaaacattgaggagttcgtttccaagctcgtcaccatcgcttccgtcgaatcg

SEQ ID NO: 193 - DNA, 1434 bp, Artificial Sequence; identical to SEQ ID NO: 188
  Synthetic construct

SEQ ID NO: 194 - DNA, 1443 bp, Artificial Sequence
  Synthetic construct
atgcccatcatcaacaagaccatgctcatcacctacgccgactctctcggcaagaacctcaaggagctcaacgagaacattgagaactacttcggtgatgctgttggtggtgtccacctgctccccttcttcccctccactggtgaccgaggcttcgcccccattgactaccacgaggttgactctgccttcggtgactgggatgatgtcaagtgcctcggtgagaagtactacctcatgttcgacttcatgatcaaccacatctcccgacagtccaagtactacaaggactaccaggagaagcacgaggcttctgcctacaaggacctcttcctcaactgggacaagttctggcccaagaaccgacctacccaggaagatgtcgatctcatctacaagcgaaaggaccgagctcccaagcaggagatccagtttgccgacggctccgtcgagcacctgtggaacaccttcggtgaggagcagattgacctcgatgtcaccaaggaagtcaccatggacttcatccgatccaccattgagaacctggctgccaacggctgtgacctcatccgactcgacgcctttgcctacgccgtcaagaagctcgacaccaacgacttcttcgtcgagcccgagatctggactctgctcgacaaggtccgagacattgctgccgtttccggtgccgagatcctccccgagatccacgagcactacaccatccagttcaagattgctgaccacgactactacgtctacgactttgctctgcccatggtcactctgtactctctgtactcctccaaggtcgaccgactcgccaagtggctcaagatgtctcccatgaagcagttcaccaccctcgacacccacgacggtatcggtgttgttgatgtcaaggacattctgaccgacgaggagatcacctacacctccaacgagctctacaaggtcggtgccaacgtcaaccgaaagtactccactgccgagtacaacaacctcgatatctaccagatcaactccacctactactctgctctcggtgacgacgaccagaagtacttcctggcccgactcatccaggcctttgcccccggtatcccccaggtctactacgttggcttcctcgccggcaagaacgatctcgagctgctcgagtccaccaaagagggccgaaacatcaaccgacactactactcctccgaggagattgctaaagaggtcaagcgacccgttgtcaaggctctgctcaacctcttcacctaccgaaaccagtccgccgcctttgacctcgacggccgaatcgaggttgagactcccaacgaggccaccattgtcatcgagcgacagaacaaggacggctctcacattgccaaggccgagatcaacctgcaggacatgacctaccgagtcaccgagaacgaccagaccatctccttcgag

SEQ ID NO: 195 - protein, 464 aa, Artificial Sequence
  Synthetic construct
MDNNHLGETLLPLAPKNGRRVLFFPYPLQGHISPMLNLANLLHSKGFTITIIHTNLNSPNQSDYPHFTFRPFDDGFPPYSKGWQLATLCSRCVEPFRECLAQIFLSDHTAPEGERESIACLIADGLWNFLGAAVYNFKLPMIVLRTGNMSNIVANVKLPCFIEKGYFDHTKEGSKLEAAVPEFPTIKFKDILKTYGSNPKAICETLTALLKEMRASSGVIWNSCKELEQSELQMICKEFPVPHFLIGPLHKYFPASSSSLVAHDPSSISWLNSKAPNSVLYVSFGSISSMDEAEFLETAWGLANSMQQFLWVVRPGSVRGSQWLESLPDGFIDKLDGRGHIVKWAPQQEVLAHQATGGFWTHCGWNSTLESMCEGVPMICSHGIMDQPINARYVTDVWKVGIELEKGFDSEEIKMAIRRLMVDKEGQEIRERSSRLKESLSNCLKQGGSSHDSVESLVDHILSF

SEQ ID NO: 196 - protein, 460 aa, Artificial Sequence
  Synthetic construct
MEERKGRRIIMFPLPFPGHFNPMIELAGIFHHRGFSVTILHTSYNFPDPSRHPHFTFRTISHNKEGEEDPLSQSETSSMDLIVLVRRLKQRYAEPFRKSVAAEVGGGETVCCLVSDAIWGKNTEVVAEEIGVRRVVLRTGGASSFCAFAAFPLLRDKGYLPIQDSRLDEPVTELPPLKVKDLPVMETNEPEELYRVVNDMVEGAKSSSGVIWNTFEDLERLSLMNCSSKLQVPFFPIGPFHKYSEDPTPKTENKEDTDWLDKQDPQSVVYASFGSLAAIEEKEFLEIAWGLRNSERPFLWVVRPGSVRGTEWLESLPLGFMENIGDKGKIVKWANQLEVLAHPAIGAFWTHCGWNSTLESICEGVPMICTSCFTDQHVNARYIVDVWRVGMLLERSKMEKKEIEKVLRSVMMEKGDGLRERSLKLKERADFCLSKDGSSSKYLDKLVSHVLSFDSYAFAS

SEQ ID NO: 197 - protein, 458 aa, Artificial Sequence
  Synthetic construct
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 198 - DNA, 1392 bp, Artificial Sequence; identical to SEQ ID NO: 38
  Synthetic construct

SEQ ID NO: 199 - DNA, 1380 bp, Artificial Sequence
  Synthetic construct
atggaagaaagaaagggtagaagaatcatcatgttcccattaccattcccaggtcacttcaacccaatgattgaattggctggtatctttcatcaccgtggtttctccgttaccatcttgcacacttcttacaacttcccagacccatccagacacccacacttcactttcagaaccatttctcacaacaaggaaggtgaagaagatccattatctcaatctgaaacctcttccatggacttgattgtcttggtcagaagattaaagcaacgttacgctgaaccattcagaaagtccgttgctgctgaagtcggtggtggtgaaaccgtttgttgtttggtttctgatgctatctggggtaagaacactgaagttgttgctgaagaaatcggtgtcagaagagttgttttgagaactggtggtgcctcttctttctgtgcctttgctgctttcccattattgagagacaagggttacttgccaatccaagattctcgtttggatgaacctgttactgaattgcctccattgaaggtcaaggacttaccagtcatggaaaccaatgaaccagaagaattgtacagagttgttaacgacatggttgaaggtgctaaatcttcttctggtgtcatctggaacactttcgaagatttggaaagattgtctttgatgaactgttcctccaaattgcaagttccattcttcccaatcggtccattccacaagtactctgaagatccaactccaaagactgaaaacaaggaagataccgactggttggacaagcaagaccctcaatccgttgtctacgcctcctttggttctttggccgctattgaagaaaaggaattcttggaaattgcttggggtctaagaaactctgaaagaccattcttatgggttgttagaccaggttccgtccgtggtactgaatggttggaatctctaccattgggtttcatggaaaacatcggtgacaagggtaagattgtcaaatgggctaaccaattggaagttttggctcacccagccattggtgctttctggacccactgtggttggaactccactttggaatccatctgtgaaggtgtcccaatgatctgtacctcctgttttaccgaccaacatgtcaacgccagatacattgtcgacgtctggagagtcggtatgttgttggaaagatccaagatggaaaagaaggaaatcgaaaaggttttgagatctgttatgatggaaaagggtgatggtttgagagaaagatctttgaaattgaaggaaagagctgatttctgtttgtccaaggacggttcttcttccaagtacttggacaaattggtttcccacgtcttatctttcgactcttacgctttcgcttct

SEQ ID NO: 200 - DNA, 1374 bp, Artificial Sequence
  Synthetic construct
atggaaaacaagactgaaaccactgttagaagaagaagaagaatcatcttattcccagttccattccaaggtcacattaacccaatcttgcaattggctaacgtcttatactccaagggtttctccatcaccatcttccacaccaacttcaacaaacctaaaacttccaactacccacacttcaccttcagatttatcttggacaacgacccacaagatgaaagaatttctaacttgccaacccatggtccattggccggtatgagaattccaatcatcaacgaacacggtgctgacgaattgagaagagaattggaattgttgatgttggcttctgaagaagatgaagaagtctcttgtttgatcactgatgctttatggtactttgctcaatctgttgctgactctttgaacttgagaagattagtcttgatgacctcttctttgttcaacttccacgctcacgtttctctaccacaatttgatgaattgggttacttggacccagatgacaagaccagattggaagaacaagcctccggtttcccaatgttgaaggtcaaggatatcaagtctgcctactccaactggcaaatcttgaaggaaattttgggtaagatgatcaagcaaaccaaggcttcttctggtgtcatctggaactccttcaaggaattggaagaatctgaattggaaaccgtcatcagagaaattccagctccatctttcttgattccattaccaaagcatttgactgcttcctcctcttctctattggaccacgacagaactgttttccaatggttggaccaacaaccaccatcttccgtcttatacgtttcctttggttccacttctgaagttgacgaaaaggacttcttggaaattgctcgtggtttggttgactccaagcaatctttcttatgggttgtcagaccaggtttcgtcaagggttccacctgggttgaacctttgccagacggtttcttgggtgaaagaggtagaattgtcaaatgggttccacaacaagaagttttggctcacggtgccattggtgctttctggactcactctggttggaactctactttggaatccgtttgtgaaggtgttccaatgattttctctgacttcggtttggaccaaccattgaatgctcgttacatgtccgatgttttgaaggttggtgtctacttggaaaacggttgggaacgtggtgaaattgctaacgccatcagaagagtcatggtcgatgaagaaggtgaatacatcagacaaaatgctcgtgtcttgaaacaaaaggctgatgtttctttgatgaagggtggttcttcttacgaatctttggaatctttggtttcctacatctccagtctc

SEQ ID NO: 201 - DNA, 1374 bp, Artificial Sequence
  Synthetic construct
atggagaacaagaccgagactaccgtccgacgacgacgacgaatcattctcttccccgtccccttccagggccacatcaaccccattctgcagctcgccaacgttctgtactccaagggcttctccatcaccatcttccacaccaacttcaacaagcccaagacctccaactacccccacttcactttccgattcatcctcgacaacgacccccaggacgagcgaatctccaacctgcccacccacggtcctctggctggtatgcgaatccccatcatcaacgagcacggtgctgacgagctccgacgagagctcgagctgctcatgctcgcctccgaagaggacgaggaagtctcctgtctgatcaccgatgctctgtggtactttgcccagtccgtcgccgactctctcaacctgcgacgactcgttctcatgacctcctctctgttcaacttccacgcccacgtttctctgccccagtttgacgagctcggttacctcgaccccgatgacaagacccgactcgaggagcaggcttccggtttccccatgctcaaggtcaaggacatcaagtccgcctactccaactggcagattctcaaggagattctcggcaagatgatcaagcagaccaaggcctcctccggtgtcatctggaactccttcaaggagctcgaggagtccgagctcgagactgtcatccgagagatccccgctccctctttcctcatccccctgcccaagcacctcaccgcttcctcctcttctctgctcgaccacgaccgaaccgtctttcagtggctcgaccagcagcccccttcctccgtcctctacgtttccttcggctccacctccgaggtcgacgagaaggacttcctcgagattgctcgaggcctcgttgactccaagcagtccttcctgtgggttgtccgacccggctttgtcaagggctccacctgggttgagcccctgcccgatggtttcctcggtgagcgaggccgaattgtcaagtgggtcccccagcaggaagttctggcccacggtgccattggtgccttctggacccactccggctggaactccactctcgagtccgtctgcgagggtgtccccatgatcttctccgactttggcctcgaccagcccctcaacgcccgatacatgtccgatgttctcaaggtcggtgtctacctcgagaacggctgggagcgaggtgagattgccaacgccatccgacgagtcatggtcgacgaggaaggtgagtacatccgacagaacgcccgagtcctcaagcagaaggccgatgtctctctcatgaagggtggttcttcttacgagtctctcgagtctctcgtttcctacatctcttctttg

SEQ ID NO: 202 - DNA, 1392 bp, Artificial Sequence
  Synthetic construct
atggacaacaaccacctcggtgagactctgctccccctcgctcccaagaacggccgacgagttctcttcttcccctaccccctccagggccacatctcccccatgctcaacctcgccaacctgctccactccaagggtttcaccatcaccatcatccacaccaacctcaactcccccaaccagtccgactacccccacttcaccttccgaccctttgacgacggtttccctccttactccaagggctggcagctcgccaccctctgctcccgatgtgtcgagcccttccgagagtgtctggcccagatcttcctgtccgaccacaccgcccccgagggtgagcgagagtccattgcctgcctcattgccgatggtctgtggaacttcctcggtgctgccgtctacaacttcaagctccccatgattgttctgcgaaccggtaacatgtccaacattgttgccaacgtcaagctcccctgcttcatcgagaagggctactttgaccacaccaaggaaggctccaagctcgaggctgccgtccccgagttccccaccatcaagttcaaggacattctcaagacctacggctccaaccccaaggccatctgtgagactctgaccgctctgctcaaggagatgcgagcttcttccggtgtcatctggaactcctgcaaggagctcgagcagtccgagctccagatgatctgcaaggagttccccgtcccccacttcctcatcggtcctctgcacaagtacttccccgcctcttcttcttctctcgttgcccacgacccctcttccatctcttggctcaactccaaggctcccaactccgtcctctacgtttcttttggctccatctcctccatggacgaggctgagttcctcgagactgcctggggtctggccaactccatgcagcagttcctgtgggttgtccgacccggctccgtccgaggttcccagtggctcgagtctctgcccgatggtttcattgacaagctcgacggccgaggccacattgtcaagtgggctccccagcaagaggttctcgcccaccaggccaccggtggtttctggacccactgtggctggaactccactctcgagtccatgtgcgagggtgtccccatgatctgctcccacggtatcatggaccagcccatcaacgcccgatacgtcaccgatgtctggaaggtcggtatcgagctcgagaagggctttgactccgaggagatcaagatggccatccgacgactcatggtcgataaagagggccaggagatccgagagcgatcttctcgactcaaggagtctctgtccaactgtctcaagcagggtggttcctcccacgactccgtcgagtctctggtcgaccacattctcagcttc

SEQ ID NO: 203 - DNA, 1380 bp, Artificial Sequence
  Syntetic construct
atggaggagcgaaagggccgacgaatcatcatgttccctctgcccttccccggccacttcaaccccatgatcgagctcgctggtatcttccaccaccgaggcttctccgtcaccatcctccacacctcctacaacttccccgacccctctcgacacccccacttcaccttccgaaccatctcccacaacaaggaaggcgaagaggaccccctgtcccagtccgagacttcttccatggacctcattgttctcgtccgacgactcaagcagcgatacgctgagcccttccgaaagtccgttgctgctgaggtcggtggtggtgagactgtctgctgcctcgtttccgatgccatctggggtaagaacaccgaggttgttgccgaggagattggtgtccgacgagttgtcctccgaaccggtggtgcctcttctttctgcgcctttgctgctttccctctgctccgagacaagggctacctccccatccaggactcccgactcgacgagcccgtcaccgagctgccccctctcaaggtcaaggatctgcccgtcatggagactaacgagcccgaggagctctaccgagttgtcaacgacatggtcgagggtgccaagtcctcttccggtgtcatctggaacacctttgaggatctcgagcgactctctctcatgaactgctcctccaagctccaggtccccttcttccccatcggtcccttccacaagtactccgaggaccccacccccaagaccgagaacaaggaagataccgactggctcgacaagcaggacccccagtccgttgtctacgcctcttttggctctctcgccgccatcgaggagaaggagttcctcgagattgcctggggtctgcgaaactccgagcgacccttcctgtgggttgtccgacccggctccgtccgaggcaccgagtggctcgagtctctgcccctcggcttcatggagaacattggtgacaagggcaagatcgtcaagtgggccaaccagctcgaggttctggcccaccccgccatcggtgccttctggacccactgtggctggaactccactctcgagtccatctgtgagggtgtccccatgatctgcacctcttgtttcaccgaccagcacgtcaacgcccgatacattgtcgatgtctggcgagtcggtatgctgctcgagcgatccaagatggagaagaaggagattgagaaggtcctccgatccgtcatgatggagaagggtgacggtctgcgagagcgatctctcaagctcaaggagcgagccgacttctgcctctccaaggacggctcctcctccaagtacctcgacaagcttgtctcccacgttctgtcttttgactcctacgcctttgcatcc

SEQ ID NO: 204 - protein, 525 aa, Artificial Sequence
  Synthetic construct
MDQLVKTEVTKKSFTAPVQKASTPVLTNKTVISGSKVKSLSSAQSSSSGPSSSSEEDDSRDIESLDKKIRPLEELEALLSSGNTKQLKNKEVAALVIHGKLPLYALEKKLGDTTRAVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKPAEPTKPNNLDATDINRLKDGSVTCIKS

SEQ ID NO: 205 - protein, 1575 aa, Artificial Sequence
  Synthetic construct
ATGGACCAATTGGTCAAGACTGAAGTCACCAAGAAATCTTTCACTGCTCCAGTCCAAAAGGCTTCCACTCCAGTTTTGACCAACAAGACCGTCATCTCCGGTTCCAAGGTTAAATCTTTGTCCTCTGCTCAATCTTCCTCCTCTGGTCCATCTTCTTCTTCTGAAGAAGATGATTCCAGAGATATCGAATCTTTGGACAAGAAAATCAGACCATTGGAAGAATTGGAAGCTCTATTGTCCTCTGGTAACACTAAGCAATTAAAGAACAAGGAAGTTGCTGCTTTGGTTATCCACGGTAAATTGCCATTGTACGCTTTGGAAAAGAAATTAGGTGACACCACCAGAGCTGTTGCTGTCAGAAGAAAGGCTTTGTCCATTTTGGCTGAAGCTCCAGTCTTGGCTTCCGACAGATTACCATACAAGAACTACGACTACGACCGTGTCTTTGGTGCTTGTTGTGAAAATGTCATTGGTTACATGCCATTACCAGTTGGTGTCATTGGTCCATTGGTTATCGACGGTACTTCTTACCACATCCCAATGGCTACCACTGAAGGTTGTTTGGTTGCTTCTGCCATGAGAGGTTGTAAGGCCATCAACGCTGGTGGTGGTGCTACCACCGTTTTGACTAAGGATGGTATGACCAGAGGTCCTGTTGTCAGATTCCCAACTTTGAAGAGATCTGGTGCTTGTAAGATCTGGTTGGATTCTGAAGAAGGTCAAAACGCCATCAAGAAGGCTTTCAACTCCACTTCCAGATTCGCTAGATTGCAACACATTCAAACTTGTTTAGCTGGTGACTTGTTGTTCATGAGATTCAGAACCACCACTGGTGACGCTATGGGTATGAACATGATCTCCAAGGGTGTTGAATACTCTTTGAAGCAAATGGTTGAAGAATACGGTTGGGAAGATATGGAAGTTGTCTCTGTTTCTGGTAACTACTGTACCGACAAGAAGCCAGCTGCCATCAACTGGATCGAAGGTCGTGGTAAGTCCGTTGTTGCTGAAGCTACCATTCCAGGTGACGTTGTCAGAAAGGTTTTGAAATCTGATGTTTCTGCTTTAGTCGAATTGAACATTGCCAAGAACTTGGTCGGTTCTGCCATGGCTGGTTCCGTCGGTGGTTTCAACGCTCATGCCGCTAACTTGGTCACTGCTGTTTTCTTGGCTTTAGGTCAAGATCCAGCTCAAAATGTCGAATCCTCTAACTGTATCACTTTGATGAAGGAAGTTGACGGTGATTTGAGAATTTCTGTTTCCATGCCATCCATTGAAGTCGGTACTATCGGTGGTGGTACTGTCTTGGAACCACAAGGTGCCATGTTGGACTTGTTGGGTGTTCGTGGTCCACACGCTACCGCTCCAGGTACTAACGCCAGACAATTGGCCAGAATTGTTGCCTGTGCCGTCTTGGCTGGTGAATTGTCTCTATGTGCCGCTTTGGCTGCTGGTCACTTGGTTCAATCTCACATGACCCACAACAGAAAGCCTGCTGAACCAACCAAACCAAACAACTTGGATGCTACTGACATTAACAGATTAAAGGACGGTTCTGTCACCTGTATCAAGTCT

SEQ ID NO: 206 - protein, 352 aa, Artificial Sequence
  Synthetic construct
MASEKEIRRERFLNVFPKLVEELNASLLAYGMPKEACDWYAHSLNYNTPGGKLNRGLSVVDTYAILSNKTVEQLGQEEYEKVAILGWCIELLQAYFLVADDMMDKSITRRGQPCWYKVPEVGEIAINDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 207 - DNA, 1056 bp, Artificial Sequence
  Synthetic construct
atggcttctgaaaaggaaatcagaagagaacgtttcttgaatgttttcccaaaattggttgaagaattgaacgcttctctattagcttacggtatgccaaaggaagcttgtgactggtacgctcactctttgaactacaacaccccaggtggtaagttgaacagaggtctatccgttgttgacacctacgccattttgtccaacaagaccgtcgaacaattaggtcaagaagaatacgaaaaggttgccatcttaggttggtgtatcgaattgttgcaagcttacttcttggttgctgatgacatgatggacaaatctatcaccagaagaggtcaaccatgttggtacaaggttccagaagtcggtgaaattgccatcaacgatgctttcatgttggaagctgccatctacaagttgttgaagtctcacttcagaaacgaaaagtactacattgacatcactgaattattccacgaagttactttccaaaccgaattgggtcaattgatggacttgattaccgctccagaagataaggtcgatttgtccaaattttccttgaagaaacactctttcattgtcactttcaagactgcttactactccttttacttgcctgttgctttggccatgtatgtcgctggtatcaccgatgaaaaggacttgaagcaagctcgtgatgtcttgattccattaggtgaatacttccaaatccaagatgactacttggactgtttcggtactccagaacaaatcggtaagattggtactgatatccaagacaacaagtgttcctgggttatcaacaaggctttggaattggcttctgctgaacaaagaaagactttggacgaaaactacggtaagaaggactctgttgctgaagctaagtgtaagaagatcttcaacgatttgaaaattgaacaattataccatgaatacgaagaatctattgccaaggacttgaaagccaagatctctcaagtcgacgaatccagaggtttcaaggctgatgtcttgactgctttcttgaacaaggtctacaagagatcaaaa

SEQ ID NO: 208 - protein, 335 aa, Artificial Sequence [sequence omitted]

SEQ ID NO: 209 - DNA, 1005 bp, Artificial Sequence; identical to SEQ ID NO: 28
  Synthetic construct

SEQ ID NO: 210 - DNA, 2139 bp, Artificial Sequence
  Synthetic construct
atggctgaattggacactttggatatcgtcgttttgggtgttatcttcttgggtactgttgcttacttcaccaagggtaagttgtggggtgtcaccaaggatccatacgctaacggttttgccgctggtggtgcttccaagccaggtagaaccagaaacattgttgaagccatggaagaatctggtaagaactgtgttgttttctacggttctcaaaccggtactgctgaagattacgcttccagattagctaaggaaggtaagtccagattcggtttgaacaccatgattgctgacttagaagattacgacttcgacaacttggataccgttccatctgacaacattgtcatgttcgttttggctacctacggtgaaggtgaacctaccgacaatgctgttgacttctacgaattcatcactggtgaagatgcttctttcaacgaaggtaacgaccctccattgggtaacttgaattatgtcgctttcggtttaggtaacaacacctacgaacactacaactccatggttagaaatgtcaacaaagctttggaaaagctaggtgcccacagaattggtgaagctggtgaaggtgacgacggtgctggtactatggaagaagatttcttggcttggaaggacccaatgtgggaagctttggctaagaagatgggtttggaagaaagagaagctgtttacgaaccaatctttgctatcaacgaaagagatgacttgactccagaagctaacgaagtttacttgggtgaaccaaataaattgcacttggaaggtactgctaagggtcctttcaactctcacaacccatacattgctccaattgctgaatcttacgaattgttctctgccaaggacagaaactgtttgcacatggaaattgatatctctggttccaacttgaaatacgaaactggtgaccacattgccatctggccaaccaacccaggtgaagaagtcaacaaattcttggatatcttggacttatccggtaagcaacactctgttgttaccgttaaggccttggaaccaactgccaaggtcccattcccaaacccaaccacttacgatgctatcctaagataccacttggaaatctgtgccccagtttcccgtcaatttgtctctactttggctgcctttgctccaaacgacgacatcaaggctgaaatgaacagattgggttctgacaaggactacttccatgaaaagactggtccacactactacaacattgccagattcttagcttccgtttctaagggtgaaaagtggaccaagattccattttccgctttcatcgaaggtttgaccaaattacaaccaagatactactccatctcctcttcttctttggtccaaccaaagaagatctccatcactgccgtcgttgaatctcaacaaattccaggtagagatgacccattcagaggtgtcgccaccaactacttgttcgctttgaagcaaaagcaaaacggtgacccaaacccagctccattcggtcaatcttacgaattgaccggtccaagaaacaaatacgatggtattcatgttccagtccacgtcagacactccaactttaaattgccttctgacccaggtaagccaatcatcatgatcggtccaggtactggtgttgctccattcagaggtttcgttcaagaaagagccaagcaagctagagatggtgtcgaagtcggtaagactttgttattcttcggttgtcgtaaatctactgaagatttcatgtaccaaaaggaatggcaagaatacaaagaagctttgggtgacaagttcgaaatgatcactgctttctccagagaaggttccaagaaggtttacgtccaacatcgtttgaaggaaagatccaaggaagtttccgacttgttgtctcaaaaggcctacttctacgtttgtggtgacgctgctcacatggctcgtgaagtcaacaccgtcttggctcaaatcattgctgaaggtagaggtgtctctgaagctaagggtgaagaaattgtcaagaacatgagatctgccaaccaataccaagtttgttctgatttcgttactttacactgtaaggaaaccacctacgctaactctgaattgcaagaagatgtctggtct

SEQ ID NO: 211 - protein, 713 aa, Artificial Sequence
  Synthetic construct
MAELDTLDIVVLGVIFLGTVAYFTKGKLWGVTKDPYANGFAAGGASKPGRTRNIVEAMEESGKNCVVFYGSQTGTAEDYASRLAKEGKSRFGLNTMIADLEDYDFDNLDTVPSDNIVMFVLATYGEGEPTDNAVDFYEFITGEDASFNEGNDPPLGNLNYVAFGLGNNTYEHYNSMVRNVNKALEKLGAHRIGEAGEGDDGAGTMEEDFLAWKDPMWEALAKKMGLEEREAVYEPIFAINERDDLTPEANEVYLGEPNKLHLEGTAKGPFNSHNPYIAPIAESYELFSAKDRNCLHMEIDISGSNLKYETGDHIAIWPTNPGEEVNKFLDILDLSGKQHSVVTVKALEPTAKVPFPNPTTYDAILRYHLEICAPVSRQFVSTLAAFAPNDDIKAEMNRLGSDKDYFHEKTGPHYYNIARFLASVSKGEKWTKIPFSAFIEGLTKLQPRYYSISSSSLVQPKKISITAVVESQQIPGRDDPFRGVATNYLFALKQKQNGDPNPAPFGQSYELTGPRNKYDGIHVPVHVRHSNFKLPSDPGKPIIMIGPGTGVAPFRGFVQERAKQARDGVEVGKTLLFFGCRKSTEDFMYQKEWQEYKEALGDKFEMITAFSREGSKKVYVQHRLKERSKEVSDLLSQKAYFYVCGDAAHMAREVNTVLAQIIAEGRGVSEAKGEEIVKNMRSANQYQVCSDFVTLHCKETTYANSELQEDVWS

SEQ ID NO: 212 - DNA, 2076 bp, Artificial Sequence
  Synthetic construct
atgacctctgctttatacgcctccgatttgttcaagcaattgaagtccatcatgggtactgactctttgtccgatgatgttgtcttagtcattgccaccacttctttggctttggttgctggtttcgttgtcttgttgtggaagaaaaccaccgctgacagatccggtgaattgaaacctttgatgattccaaagtctttgatggccaaggacgaagatgacgacttggacttgggttctggtaagaccagagtctccattttcttcggtactcaaaccggtactgctgaaggtttcgctaaggctttgtctgaagaaattaaagccagatacgaaaaggctgccgttaaggttatcgatttggatgactacgctgctgacgatgaccaatacgaagaaaagttgaagaaggaaactttggctttcttctgtgttgctacctacggtgacggtgaaccaactgacaatgctgctagattctacaagtggttcaccgaagaaaacgaaagagacatcaaattgcaacaattggcttacggtgtctttgctttgggtaacagacaatacgaacatttcaacaagatcggtattgtcttggacgaagaattatgtaagaagggtgccaagagattgattgaagtcggtttgggtgacgatgaccaatctattgaagatgacttcaacgcttggaaggaatctttgtggtctgaattagacaagttattgaaggacgaagatgacaagtccgttgctactccatacactgctgtcatcccagaataccgtgtcgtcacccacgacccaagattcaccacccaaaagtccatggaatccaacgttgccaacggtaacaccactattgacatccaccacccatgtcgtgttgatgttgctgttcaaaaggaattgcacacccacgaatctgaccgttcttgtattcacttggaattcgatatctccagaaccggtatcacttacgaaactggtgaccacgtcggtgtctacgctgaaaaccacgttgaaatcgtcgaagaagccggtaaattgttgggtcactctttggacttggttttctccatccacgctgacaaggaagatggttctccattagaatccgccgtcccacctccattcccaggtccatgtaccttaggtactggtctagctcgttacgctgatttgttgaacccaccaagaaagtctgctttggttgctttggctgcttacgctactgaaccttctgaagctgaaaagttgaagcatttgacttctccagacggtaaggatgaatactcccaatggatcgttgcttctcaaagatctctattggaagttatggctgctttcccatctgccaagccaccattgggtgttttctttgctgccattgctccaagattgcaaccaagatactactccatttcttcttctccaagattggctccatctagagtccacgtcacctctgctttggtttacggtccaactccaaccggtagaatccacaaaggtgtttgttccacctggatgaagaacgctgttccagctgaaaagtcccacgaatgttccggtgctccaatctttatcagagcttctaacttcaagttgccatccaacccatctactccaatcgtcatggttggtccaggtactggtttggctccattcagaggtttcttacaagaaagaatggctttgaaagaagatggtgaagaattgggttcttctctattgttcttcggttgtagaaacagacaaatggacttcatctacgaagatgaattaaacaactttgtcgaccaaggtgttatctccgaattgatcatggccttctctagagaaggtgctcaaaaggaatacgttcaacataaaatgatggaaaaggctgctcaagtttgggacttgatcaaggaagaaggttacttgtacgtttgtggtgatgccaaaggtatggccagagatgtccacagaactttgcacaccattgtccaagaacaagaaggtgtttcctcttccgaagctgaagccattgtcaagaagttacaaactgaaggtcgttatttgagagatgtctgg

SEQ ID NO: 213 - protein, 692 aa, Artificial Sequence [sequence omitted]

SEQ ID NO: 214 - DNA, 2133 bp, Artificial Sequence
  Synthetic construct
atgtcctcttcttcttcttcttctacttccatgattgatttgatggctgccatcatcaagggtgaaccagtcattgtctctgacccagccaacgcttctgcttacgaatccgttgctgctgaattgtcctccatgttgattgaaaacagacaattcgctatgattgtcactacttccattgctgtcttgattggttgtatcgtcatgttggtctggagaagatccggttccggtaactccaagagagttgaaccattgaagccattagtcatcaagccaagagaagaagaaattgatgacggtagaaagaaggtcaccatcttctttggtactcaaaccggtactgctgaaggttttgctaaggctttgggtgaagaagccaaagctagatacgaaaagaccagattcaagatcgttgacttggacgactacgctgctgatgacgacgaatacgaagaaaagttgaagaaggaagatgttgccttcttcttcttggctacttacggtgatggtgaaccaactgacaatgctgccagattctacaaatggttcaccgaaggtaacgacagaggtgaatggttaaagaacttgaaatacggtgttttcggtctaggtaacagacaatacgaacacttcaacaaggttgccaaggttgtcgatgacatcttggttgaacaaggtgctcaaagattagtccaagtcggtttgggtgatgatgaccaatgtatcgaagatgacttcactgcttggagagaagctttgtggccagaattggacaccatcttaagagaagaaggtgataccgctgttgccaccccatacactgctgctgttttggaatacagagtttctatccacgactctgaagatgccaagttcaacgacatcaacatggctaacggtaacggttacactgttttcgacgctcaacacccatacaaggccaatgttgctgtcaagagagaattgcacactccagaatctgatcgttcttgtatccacttggaatttgacattgctggttctggtttgacctacgaaaccggtgaccacgtcggtgtcttatgtgacaacttgtctgaaactgtcgatgaagctttgagattattggacatgtctccagacacttatttctccttgcatgctgaaaaggaagatggtactccaatttcttcttccttgcctcctccattcccaccatgtaacttgagaaccgctttaaccagatacgcttgtttgctatcctctccaaagaagtccgctttggttgctttggctgctcacgcttctgacccaactgaagctgaaagattgaaacatttggcttccccagctggtaaggatgaatactccaaatgggttgttgaatctcaaagatctttgttggaagtcatggctgaattcccatctgccaagccaccattgggtgttttcttcgccggtgttgctccaagattgcaaccaagattttactccatctcttcttctccaaagattgctgaaaccagaattcacgttacctgtgccttggtctacgaaaagatgccaaccggtagaattcacaagggtgtttgttccacctggatgaagaacgctgttccatacgaaaagtctgaaaactgttcttctgctccaatcttcgtccgtcaatccaacttcaagttgccatctgactccaaggtcccaatcatcatgatcggtccaggtactggtttagctccattcagaggtttcttgcaagaaagattggccttagttgaatctggtgtcgaattgggtccttctgttttgttcttcggttgtagaaaccgtcgtatggacttcatctacgaagaagaattgcaaagatttgtcgaatctggtgctttggctgaattgtccgttgctttctctcgtgaaggtccaaccaaagaatacgttcaacacaagatgatggacaaagcctccgacatctggaacatgatctcccaaggtgcttacttgtacgtttgtggtgatgctaaaggtatggccagagatgtccacagatctttacataccattgcccaagaacaaggttccatggactccaccaaggctgaaggtttcgttaagaacttgcaaacttctggtcgttacttgagagatgtttgg

SEQ ID NO: 215 - protein, 711 aa, Artificial Sequence
  Synthetic consrruct
MSSSSSSSTSMIDLMAAIIKGEPVIVSDPANASAYESVAAELSSMLIENRQFAMIVTTSIAVLIGCIVMLVWRRSGSGNSKRVEPLKPLVIKPREEEIDDGRKKVTIFFGTQTGTAEGFAKALGEEAKARYEKTRFKIVDLDDYAADDDEYEEKLKKEDVAFFFLATYGDGEPTDNAARFYKWFTEGNDRGEWLKNLKYGVFGLGNRQYEHFNKVAKVVDDILVEQGAQRLVQVGLGDDDQCIEDDFTAWREALWPELDTILREEGDTAVATPYTAAVLEYRVSIHDSEDAKFNDINMANGNGYTVFDAQHPYKANVAVKRELHTPESDRSCIHLEFDIAGSGLTYETGDHVGVLCDNLSETVDEALRLLDMSPDTYFSLHAEKEDGTPISSSLPPPFPPCNLRTALTRYACLLSSPKKSALVALAAHASDPTEAERLKHLASPAGKDEYSKWVVESQRSLLEVMAEFPSAKPPLGVFFAGVAPRLQPRFYSISSSPKIAETRIHVTCALVYEKMPTGRIHKGVCSTWMKNAVPYEKSENCSSAPIFVRQSNFKLPSDSKVPIIMIGPGTGLAPFRGFLQERLALVESGVELGPSVLFFGCRNRRMDFIYEEELQRFVESGALAELSVAFSREGPTKEYVQHKMMDKASDIWNMISQGAYLYVCGDAKGMARDVHRSLHTIAQEQGSMDSTKAEGFVKNLQTSGRYLRDVW

SEQ ID NO: 216 - DNA, 2130 bp, Artificial Sequence
  Synthetic construct
atgcaatctgattccgttaaggtttctccattcgacttagtctctgctgccatgaacggtaaggctatggaaaagttgaacgcttctgaatctgaggacccaactactttaccagctttaaagatgttggttgaaaacagagaattgttgactttattcaccacctcctttgctgtcttgattggttgtttggttttcttgatgtggagaagatcttcttctaagaagttggttcaagacccagttcctcaagtcatcgtcgtcaagaagaaggaaaaggaatctgaagtcgatgacggtaagaagaaagtttccatcttctacggtactcaaaccggtactgctgaaggtttcgctaaagctttagttgaagaagctaaggtcagatacgaaaagacctctttcaaggttatcgatttggacgactacgccgctgacgacgacgaatacgaagaaaagttgaagaaggaatctctagctttcttcttcttggctacctacggtgacggtgaaccaaccgacaatgctgccaacttctacaaatggttcaccgaaggtgatgacaagggtgaatggttgaagaaattgcaatacggtgttttcggtttaggtaacagacaatacgaacacttcaacaagattgccatcgtcgttgatgacaaattgactgaaatgggtgccaagagattggttccagtcggtttgggtgatgatgaccaatgtattgaagatgactttaccgcttggaaggaattagtttggccagaattagaccaattgttgagagatgaagatgacacctctgttaccaccccatacaccgccgctgtcttggaataccgtgtcgtttaccatgacaaaccagctgactcttacgctgaagatcaaacccacaccaacggtcacgttgtccacgacgctcaacacccatccagatctaacgttgctttcaagaaggaattgcacacttcccaatctgatcgttcttgtacccacttggaatttgacatctcccacaccggtttgtcttacgaaaccggtgaccatgttggtgtctactctgaaaacttgtctgaagttgtcgacgaagctttgaaattgttgggtttgtctccagacacttacttctccgtccacgctgacaaagaagatggtactccaatcggtggtgcttctttgcctccaccattcccaccatgtactctaagagatgctttgacccgttatgctgacgttctatcctctccaaagaaggttgctttgttggctttggctgctcatgcttctgatccatctgaagctgacagattgaagttcttggcttccccagccggtaaggacgaatacgctcaatggattgttgccaaccaaagatccttgttggaagtcatgcaatctttcccatctgccaagcctccattgggtgttttctttgccgctgttgccccaagattgcaaccaagatactactccatctcctcttctccaaagatgtccccaaacagaattcacgtcacttgtgctttggtttacgaaaccactccagctggtagaattcacagaggtttgtgttccacctggatgaagaatgccgtcccattaactgaatctccagactgttcccaagcttctatcttcgtcagaacttccaacttcagattgccagtcgatccaaaggtcccagttatcatgatcggtccaggtactggtttggctccattcagaggtttcttgcaagaaagattagctttgaaagaatctggtactgaattgggttcctccatcttcttcttcggttgtagaaacagaaaggtcgattttatctacgaagatgaattgaacaacttcgttgaaactggtgctttgtctgaattgattgtcgctttctccagagaaggtactgccaaggaatacgtccaacacaagatgtcccaaaaggcttctgatatctggaagttgttgtctgaaggtgcttacttgtacgtttgtggtgatgctaaaggtatggccaaggacgttcacagaactttgcacactattgttcaagaacaaggttctttggactcctccaaggctgaattatacgtcaagaacttgcaaatgtccggtcgttacttgagagatgtatgg

SEQ ID NO: 217 - protein, 710 aa, Artificial Sequence
  Synthetic construct
MQSDSVKVSPFDLVSAAMNGKAMEKLNASESEDPTTLPALKMLVENRELLTLFTTSFAVLIGCLVFLMWRRSSSKKLVQDPVPQVIVVKKKEKESEVDDGKKKVSIFYGTQTGTAEGFAKALVEEAKVRYEKTSFKVIDLDDYAADDDEYEEKLKKESLAFFFLATYGDGEPTDNAANFYKWFTEGDDKGEWLKKLQYGVFGLGNRQYEHFNKIAIVVDDKLTEMGAKRLVPVGLGDDDQCIEDDFTAWKELVWPELDQLLRDEDDTSVTTPYTAAVLEYRVVYHDKPADSYAEDQTHTNGHVVHDAQHPSRSNVAFKKELHTSQSDRSCTHLEFDISHTGLSYETGDHVGVYSENLSEVVDEALKLLGLSPDTYFSVHADKEDGTPIGGASLPPPFPPCTLRDALTRYADVLSSPKKVALLALAAHASDPSEADRLKFLASPAGKDEYAQWIVANQRSLLEVMQSFPSAKPPLGVFFAAVAPRLQPRYYSISSSPKMSPNRIHVTCALVYETTPAGRIHRGLCSTWMKNAVPLTESPDCSQASIFVRTSNFRLPVDPKVPVIMIGPGTGLAPFRGFLQERLALKESGTELGSSIFFFGCRNRKVDFIYEDELNNFVETGALSELIVAFSREGTAKEYVQHKMSQKASDIWKLLSEGAYLYVCGDAKGMAKDVHRTLHTIVQEQGSLDSSKAELYVKNLQMSGRYLRDVW

SEQ ID NO: 218 - DNA, 1362 bp, Artificial Sequence
  Synthetic construct
atgtccttgaaaggtaacgacaaggaattacatttggtcatgttcccattctttgctttcggtcacatcactccatttgtccaattgtccaacaagatctcctctttgtacccaggtgtcaagatcactttcttggctgcttctgcttctgtttccagaatcgaaaccatgttgaacccatctaccaacaccaaggtcattccattgactttgccaagagtcgatggtctaccagaaggtgttgaaaacactgctgacgcttctccagctaccattggtctattggttgttgccattgatttgatgcaacctcaaatcaagactttattggctaacttgaagccagacttcgttatcttcgacttcgtccactggtggttaccagaaattgcttctgaattgggtatcaagaccatctacttctccgtttacatggccaacattgtcatgccatccacttccaagttgaccggtaacaagccatctaccgtcgaagatatcaaggctttgcaacaatcttacggtattccagttaagactttcgaagccatctctttgatgaacgttttcaagtctttccacgactggatggacaaatgtatcaacggttgtaacttgatgttgatcaagtcttgtcgtgaaatggaaggttccagaattgacgatgtcaccaagcaatctaccagaccagttttcttgattggtccagttgttccagaacctcactctggtgaattggacgaaacctgggctaactggttgaacagattcccagctaagtctgtcatctactgttcctttggttctgaaactttcttgaccgatgaccaaatcagagaattggccttgggtttagaattgactggtttgccattcttcttggtcttgaacttcccagccaatgtcgacaaatctgctgaattgaagagaactttaccagatggtttcttggaaagagttaaggacaagggtattgtccactctggttgggttcaacaaagacacatcttggctcatgactctgttggttgttacgttttccacgctggttacggttccgttatcgaaggtttggtcaatgactgtcaattagtcatgttgccaatgaaggttgaccaattcaccaactccaaggttattgctttggaattgaaggctggtgttgaagttaacagaagagatgaagatggttacttcggtaaggacgatgtcttcgaagctgtcgaatctgtcatgatggacactgaaaacgaaccagccaagtccatcagagaaaaccaccgtaaattgaaggaatttttgcaaaacgatgaaatccaaaagaaatacattgctgatttcgttgaaaacttgaaagcgtta

SEQ ID NO: 219 - protein, 454 aa, Artificial Sequence
  Synthetic construct
MSLKGNDKELHLVMFPFFAFGHITPFVQLSNKISSLYPGVKITFLAASASVSRIETMLNPSTNTKVIPLTLPRVDGLPEGVENTADASPATIGLLVVAIDLMQPQIKTLLANLKPDFVIFDFVHWWLPEIASELGIKTIYFSVYMANIVMPSTSKLTGNKPSTVEDIKALQQSYGIPVKTFEAISLMNVFKSFHDWMDKCINGCNLMLIKSCREMEGSRIDDVTKQSTRPVFLIGPVVPEPHSGELDETWANWLNRFPAKSVIYCSFGSETFLTDDQIRELALGLELTGLPFFLVLNFPANVDKSAELKRTLPDGFLERVKDKGIVHSGWVQQRHILAHDSVGCYVFHAGYGSVIEGLVNDCQLVMLPMKVDQFTNSKVIALELKAGVEVNRRDEDGYFGKDDVFEAVESVMMDTENEPAKSIRENHRKLKEFLQNDEIQKKYIADFVENLKAL

SEQ ID NO: 220 - DNA, 1362 bp, Artificial Sequence
  Synthetic construct
atgtccttgaaaggtaacgacaaggaattacatttggtcatgttcccattctttgctttcggtcacatcactccatttgtccaattgtccaacaagatctcctctttgtacccaggtgtcaagatcactttcttggctgcttctgcttctgtttccagaatcgaaaccatgttgaacccatctaccaacaccaaggtcattccattgactttgccaagagtcgatggtctaccagaaggtgttgaaaacactgctgacgcttctccagctaccattggtctattggttgttgccattgatttgatgcaacctcaaatcaagactttattggctaacttgaagccagacttcgttatcttcgacttcgtccactggtggttaccagaaattgcttctgaattgggtatcaagaccatctacttctccgtttacatggccaacattgtcatgccatccacttccaagttgaccggtaacaagccatctaccgtcgaagatatcaaggctttgcaacaatctgacggtattccagttaagactttcgaagccatctctttgatgaacgttttcaagtctttccacgactggatggacaaatgtatcaacggttgtaacttgatgttgatcaagtcttgtcgtgaaatggaaggttccagaattgacgatgtcaccaagcaatctaccagaccagttttcttgattggtccagttgttccagaacctcactctggtgaattggacgaaacctgggctaactggttgaacagattcccagctaagtctgtcatctactgttcctttggttctgaaactttcttgaccgatgaccaaatcagagaattggccttgggtttagaattgactggtttgccattcttcttggtcttgaacttcccagccaatgtcgacaaatctgctgaattgaagagaactttaccagatggtttcttggaaagagttaaggacaagggtattgtccactctggttgggttcaacaaagacacatcttggctcatgactctgttggttgttacgttttccacgctggttacggttccgttatcgaaggtttggtcaatgactgtcaattagtcatgttgccaatgaaggttgaccaattcaccaactccaaggttattgctttggaattgaaggctggtgttgaagttaacagaagagatgaagatggttacttcggtaaggacgatgtcttcgaagctgtcgaatctgtcatgatggacactgaaaacgaaccagccaagtccatcagagaaaaccaccgtaaattgaaggaatttttgcaaaacgatgaaatccaaaagaaatacattgctgatttcgttgaaaacttgaaagcgtta

SEQ ID NO: 221 - protein, 454 aa, Artificial Sequence
  Synthetic construct
MSLKGNDKELHLVMFPFFAFGHITPFVQLSNKISSLYPGVKITFLAASASVSRIETMLNPSTNTKVIPLTLPRVDGLPEGVENTADASPATIGLLVVAIDLMQPQIKTLLANLKPDFVIFDFVHWWLPEIASELGIKTIYFSVYMANIVMPSTSKLTGNKPSTVEDIKALQQSDGIPVKTFEAISLMNVFKSFHDWMDKCINGCNLMLIKSCREMEGSRIDDVTKQSTRPVFLIGPVVPEPHSGELDETWANWLNRFPAKSVIYCSFGSETFLTDDQIRELALGLELTGLPFFLVLNFPANVDKSAELKRTLPDGFLERVKDKGIVHSGWVQQRHILAHDSVGCYVFHAGYGSVIEGLVNDCQLVMLPMKVDQFTNSKVIALELKAGVEVNRRDEDGYFGKDDVFEAVESVMMDTENEPAKSIRENHRKLKEFLQNDEIQKKYIADFVENLKAL

SEQ ID NO: 222 - DNA, 1449 bp, Artificial Sequence
  Synthetic construct
atggaccaaatggccaagattgacgaaaagaagcctcacgttgttttcattccattcccagctcaatctcacatcaagtgtatgttgaaattggccagaattttgcaccaaaagggtttgtacatcactttcatcaacactgacaccaaccacgaaagattggttgcctccggtggtactcaatggttggaaaatgctccaggtttctggttcaagaccgtcccagatggtttcggttctgccaaggatgacggtgtcaagccaactgatgctttgagagaattgatggactacttgaagaccaacttcttcgatttgttcttggacttggtcttgaagttggaagttccagctacctgtatcatctgtgatggttgtatgacctttgctaacaccattagagctgctgaaaagttgaacattccagtcatcttattctggaccatggctgcttgtggtttcatggctttctaccaagctaaggtcttaaaggaaaaggaaattgttccagtcaaggacgaaacctacttgaccaatggttacttggacatggaaattgactggatcccaggtatgaagagaatcagattacgtgacttgcctgaattcatcttggccaccaagcaaaactactttgctttcgaattcttgtttgaaactgctcaattagctgacaaggtttctcacatgatcattcacactttcgaagaattggaagcttctttagtctctgaaatcaaatctattttcccaaacgtttacactatcggtccattacaattgttgttgaacaagatcactcaaaaggaaaccaacaacgattcttactctttatggaaggaagaaccagaatgtgtcgaatggttgaactccaaggaaccaaactccgttgtttacgtcaactttggttctttggctgtcatgtctttgcaagatttggtcgaattcggttggggtttggttaactccaaccattacttcttatggatcatcagagctaacttgattgacggtaagccagctgtcatgccacaagaattgaaggaagccatgaacgaaaaaggtttcgttggttcttggtgttcccaagaagaagttttgaaccatccagccgttggtggtttcttgactcactgtggctggggttccatcattgaatctctatccgctggtgttccaatgttgggttggccatccattggtgaccaaagagccaactgtcgtcaaatgtgtaaggaatgggaagttggtatggaaatcggtaagaacgttaagagagatgaagtcgaaaaattagtcagaatgttgatggaaggtttggaaggtgaaagaatgagaaagaaggctttggaatggaagaaatctgctactttggctacttgttgtaacggttcctcttctttggatgttgaaaaattggctaacgaaatcaagaaattgtccaggaac

SEQ ID NO: 223 - protein, 483 aa, Artificial Sequence
  Synthetic construct
MDQMAKIDEKKPHVVFIPFPAQSHIKCMLKLARILHQKGLYITFINTDTNHERLVASGGTQWLENAPGFWFKTVPDGFGSAKDDGVKPTDALRELMDYLKTNFFDLFLDLVLKLEVPATCIICDGCMTFANTIRAAEKLNIPVILFWTMAACGFMAFYQAKVLKEKEIVPVKDETYLTNGYLDMEIDWIPGMKRIRLRDLPEFILATKQNYFAFEFLFETAQLADKVSHMIIHTFEELEASLVSEIKSIFPNVYTIGPLQLLLNKITQKETNNDSYSLWKEEPECVEWLNSKEPNSVVYVNFGSLAVMSLQDLVEFGWGLVNSNHYFLWIIRANLIDGKPAVMPQELKEAMNEKGFVGSWCSQEEVLNHPAVGGFLTHCGWGSIIESLSAGVPMLGWPSIGDQRANCRQMCKEWEVGMEIGKNVKRDEVEKLVRMLMEGLEGERMRKKALEWKKSATLATCCNGSSSLDVEKLANEIKKLSRN

SEQ ID NO: 224 - DNA, 1404 bp, Artificial Sequence
  Synthetic construct
atgccaatctccgatatcaatgctggttcccacattttggttttcccatacccagctcaaggtcacatgttgactctattagatttgacccaccaattggccatcagaaacttgactatcactatcttagtcaccccaaagaacttgccaaccatttctccattgttggctgctcatccaaccactgtttctgctttgttgttgccattaccacctcacccagccatcccatctggtattgaaaacgtcaaggacttgccaaacgatgctttcaaggctatgatggttgctttaggtgacttgtacaacccattgagagactggttcagaaaccaacctaacccaccagttgccatcatttctgacttcttcttgggttggactcaccacttggctgtcgaattaggtatcagaagatacactttctctccatctggtgctttggctttgtccgtcattttctctttatggagataccaaccaaagagaatcgatgtcgaaaacgaaaaggaagctatcaaattcccaaagattccaaactctccagaatacccatggtggcaattatctccaatctacagatcttacgttgaaggtgacccagattctgaattcatcaaggatggtttcttggctgatattgcttcctggggtattgtcatcaactctttcaccgaattggaacaagtctacgttgaccatttgaagcatgaattgggtcacgaccaagtctttgctgtcggtccattattgcctccaggtgacaagacttctggtagaggtggttcttcttccaacgatgtcttgtcctggttggacacctgtgctgacagaaccgttgtctacgtttgtttcggttctcaaatggttttgaccaacggtcaaatggaagttgttgctttgggtttggaaaagtcccgtgtcaaatttgtctggtccgtcaaggaaccaactgttggtcacgaagctgctaactacggtcgtgttccaccaggtttcgaagacagagtttccggtcgtggtttggttatcagaggttgggttccacaagttgccattttgtctcacgactccgttggtgttttcttgacccactgtggttggaactctgtcatggaagctgttgctgctgaagttttgatgttgacctggccaatgtccgctgaccaattctccaatgccactttgttgcacgaattgaaggttggtatcaaggtttgtgaaggttccaacattgtcccaaactctgacgaattggctgaattgttctccaaatctctatccgatgaaactagattggaaagaaagagagtcaaggaatttgccaaatctgccaaggaagccgtcggtccaaagggttcctctgtcggtgaattagaaagattggttgacaacttgtctttg

SEQ ID NO: 225 - protein, 468 aa, Artificial Sequence
  Synthetic construct
MPISDINAGSHILVFPYPAQGHMLTLLDLTHQLAIRNLTITILVTPKNLPTISPLLAAHPTTVSALLLPLPPHPAIPSGIENVKDLPNDAFKAMMVALGDLYNPLRDWFRNQPNPPVAIISDFFLGWTHHLAVELGIRRYTFSPSGALALSVIFSLWRYQPKRIDVENEKEAIKFPKIPNSPEYPWWQLSPIYRSYVEGDPDSEFIKDGFLADIASWGIVINSFTELEQVYVDHLKHELGHDQVFAVGPLLPPGDKTSGRGGSSSNDVLSWLDTCADRTVVYVCFGSQMVLTNGQMEVVALGLEKSRVKFVWSVKEPTVGHEAANYGRVPPGFEDRVSGRGLVIRGWVPQVAILSHDSVGVFLTHCGWNSVMEAVAAEVLMLTWPMSADQFSNATLLHELKVGIKVCEGSNIVPNSDELAELFSKSLSDETRLERKRVKEFAKSAKEAVGPKGSSVGELERLVDNLSL

SEQ ID NO: 226 - DNA, 1383 bp, Artificial Sequence
  Synthetic construct
atggaatcttccaaggtcattttgtacccatctccaggtattggtcacttggtttccatggtcgaattgggtaaattgattcacacccaccacccatctctatccgtcatcatcttggttttgccagctacctacgaaactggttccaccaccacctacatcaacactgtttctaccaccactccattcatcactttccaccacttgccagtcattccattgccaccagactcctcttctgaatttatcgatttggctttcgacattccacaattatacaacccagttgtctacaacactttggttgccatctctgaaacttccaccatcaaggctgttatcttggacttctttgtcaacgccgctttccaaatctccaagtctttggacttgccaacctactacttcttcacttctggtgcttctggtctatgtgctttcttgcatttgccaactatctacaagacctactccggtaacttcaaggacttggacactttcatcaacattccaggtgttcctcctatccactcttctgacatgccaaccgtcttattcgacaaggaatccaactcttacaagaactttgtcaagacttccaacaacatggccaaatcttctggtgtcattgctaactccttcttgcaattggaagaaagagctgctcaaactttgagagatggtaagtccatcaccgatggtccatctccaccaatctacttgattggtccattgatcgcttctggtaaccaagttgaccataatgaaaacgaatgtttgaaatggttaaacactcaaccatccaaatctgttgttttcttgtgtttcggttctcaaggtgttttcaagaaggaacaattgaaggaaattgctgttggtttggaaagatctggtcaaagattcttatgggttgtcagaaagcctccatctgatggtggtaaggaattcggtttggatgacgtcttgccagaaggtttcgttgccagaaccaaggaaaagggtttggttgtcaagaactgggctccacaaccagctattttgggtcacgaatctgtcggtggtttcgtttcccactgtggttggaactcttctttggaagccgttgttttcggtgtcccaatggttgcttggccattatacgctgaacaaaagatgaaccgtgtctacttggtcgaagaaatcaaggttgctttatggttaagaatgtccgctgatggttttgtctctgctgaagctgttgaagaaactgtcagacaattgatggacggtagaagagttcgtgaaagaattttggaaatgtccaccaaggccaaggccgctgtcgaagatggtggttcttccagagttgacttcttcaaattgactgaatcctggacccacaag

SEQ ID NO: 227 - protein, 461 aa, Artificial Sequence
  Synthetic construct
MESSKVILYPSPGIGHLVSMVELGKLIHTHHPSLSVIILVLPATYETGSTTTYINTVSTTTPFITFHHLPVIPLPPDSSSEFIDLAFDIPQLYNPVVYNTLVAISETSTIKAVILDFFVNAAFQISKSLDLPTYYFFTSGASGLCAFLHLPTIYKTYSGNFKDLDTFINIPGVPPIHSSDMPTVLFDKESNSYKNFVKTSNNMAKSSGVIANSFLQLEERAAQTLRDGKSITDGPSPPIYLIGPLIASGNQVDHNENECLKWLNTQPSKSVVFLCFGSQGVFKKEQLKEIAVGLERSGQRFLWVVRKPPSDGGKEFGLDDVLPEGFVARTKEKGLVVKNWAPQPAILGHESVGGFVSHCGWNSSLEAVVFGVPMVAWPLYAEQKMNRVYLVEEIKVALWLRMSADGFVSAEAVEETVRQLMDGRRVRERILEMSTKAKAAVEDGGSSRVDFFKLTESWTHK

SEQ ID NO: 228 - DNA, 1455 bp, Artificial Sequence
  Synthetic construct
atgtacaacgttacttaccatcaaaactccaaggccatggctacctctgactccattgtcgacgacagaaagcaattgcacgttgccactttcccatggttggctttcggtcacatcttgccattcttgcaattgtccaaattgattgctgaaaagggtcacaaagtctctttcttgtctaccaccagaaacatccaaagattgtcctctcacatctctccattgattaacgttgtccaattgactttaccaagagtccaagaattgccagaagatgctgaagctactactgatgttcacccagaagatatccaatacttgaagaaggctgtcgatggtttgcaaccagaagttaccagattcttggaacaacactctccagactggatcatctacgacttcactcactactggttaccatccattgctgcttctttgggtatctccagagcttacttctgtgttatcactccatggaccattgcttacttggctccatcttctgatgccatgatcaacgactctgatggtagaaccactgttgaagatttgaccaccccacctaaatggttcccattcccaaccaaggtctgttggagaaagcatgatttggccagaatggaaccatacgaagctccaggtatctctgacggttacagaatgggtatggttttcaagggttctgactgtttgttgttcaaatgttaccatgaattcggtactcaatggttacctctattagaaactttgcaccaagttccagttgttccagtcggtttgttgcctccagaaatcccaggtgacgaaaaggacgaaacctgggtttccatcaagaaatggttggatggtaagcaaaagggttccgttgtctacgttgctttaggttctgaagctttagtctctcaaactgaagttgtcgaattggctttgggtttggaattgtccggtttgccatttgtctgggcttacagaaagccaaagggtccagccaagtctgattctgtcgaattaccagatggtttcgtcgaaagaacccgtgaccgtggtttggtctggacttcctgggctccacaattgagaattttgtcccacgaatctgtctgtggtttcttgactcactgtggttctggttccattgttgaaggtttgatgttcggtcacccattgatcatgttgccaatcttctgtgaccaaccattaaacgctagattgttggaagacaagcaagtcggtattgaaattccaagaaacgaagaagacggttgtttgaccaaggaatccgttgccagatctttgagatctgttgttgtcgaaaacgaaggtgaaatctacaaggctaacgctcgtgctctatccaagatctacaacgacaccaaggtcgaaaaggaatacgtttctcaatttgttgactacttggaaaagaacgccagagctgttgccattgaccacgaaagt

SEQ ID NO: 229 - protein, 485 aa, Artificial Sequence; identical to SEQ ID NO: 165
  Synthetic construct

SEQ ID NO: 230 - DNA, 1485 bp, Artificial Sequence
  Synthetic construct
atgtctccaaagatggttgctccaccaaccaacttgcacttcgtcttattcccattgatggctcaaggtcacttggttccaatggtcgacattgctagaattttggctcaaagaggtgctaccgtcaccatcatcaccactccataccatgccaacagagtcagaccagttatctccagagccattgctaccaacttgaaaatccaattgttggaattgcaattgagatccactgaagctggtttgccagaaggttgtgaatctttcgaccaattgccatctttcgaatactggaagaacatctccactgccattgacttgttgcaacaaccagctgaagatctattgagagaattgtctccacctccagactgtatcatctccgatttcttgttcccatggaccactgatgtcgccagaagattgaacattccaagattggttttcaacggtccaggttgtttctacttgttgtgtatccacgttgccatcacttctaacatcttaggtgaaaacgaacctgtttcctccaacactgaaagagttgttttgccaggtttaccagatcgtattgaagttaccaaattgcaaatcgtcggttcttccagaccagctaacgttgacgaaatgggttcctggttaagagctgtcgaagctgaaaaggcttctttcggtattgtcgtcaacacctttgaagaattggaaccagaatacgtcgaagaatacaagaccgtcaaggacaagaagatgtggtgtatcggtccagtttctctatgtaacaagactggtccagacttggctgaaagaggtaacaaggctgccatcaccgaacacaactgtttgaaatggttggatgaaagaaagttgggttctgtcttgtacgtttgtttgggttctttggccagaatctccgctgctcaagccattgaattaggtttaggtttggaatctatcaacagaccatttatctggtgtgttagaaacgaaactgatgaattgaagacttggttcttggacggtttcgaagaaagagttcgtgacagaggtttgattgttcacggttgggctccacaagttttgatcttatctcacccaaccattggtggtttcttgactcactgtggttggaactctaccattgaatccatcactgctggtgttccaatgatcacctggccattctttgctgaccaattcttgaatgaagctttcatcgttgaagttttgaaaattggtgtcagaatcggtgttgaaagagcttgtttgttcggtgaagaagacaaggtcggtgtcttagtcaagaaggaagatgttaagaaggctgttgaatgtttgatggacgaagatgaagacggtgaccaaagaagaaagcgtgtcattgaattggccaagatggctaagattgctatggctgaaggtggttcttcttacgaaaacgtttcctctttgatcagagatgtcactgaaactgtccgtgctcctcat

SEQ ID NO: 231 - protein, 495 aa, Artificial Sequence
  Synthetic construct
MSPKMVAPPTNLHFVLFPLMAQGHLVPMVDIARILAQRGATVTIITTPYHANRVRPVISRAIATNLKIQLLELQLRSTEAGLPEGCESFDQLPSFEYWKNISTAIDLLQQPAEDLLRELSPPPDCIISDFLFPWTTDVARRLNIPRLVFNGPGCFYLLCIHVAITSNILGENEPVSSNTERVVLPGLPDRIEVTKLQIVGSSRPANVDEMGSWLRAVEAEKASFGIVVNTFEELEPEYVEEYKTVKDKKMWCIGPVSLCNKTGPDLAERGNKAAITEHNCLKWLDERKLGSVLYVCLGSLARISAAQAIELGLGLESINRPFIWCVRNETDELKTWFLDGFEERVRDRGLIVHGWAPQVLILSHPTIGGFLTHCGWNSTIESITAGVPMITWPFFADQFLNEAFIVEVLKIGVRIGVERACLFGEEDKVGVLVKKEDVKKAVECLMDEDEDGDQRRKRVIELAKMAKIAMAEGGSSYENVSSLIRDVTETVRAPH

SEQ ID NO: 232 - DNA, 1272 bp, Artificial Sequence
  Synthetic construct
atgttgcaattggctacctacttgcactctcaaggtatctccatcactattgctcaatacccaaacttcaactctccagactcctccaaccacccagaattgactttcttaccattatcttccggtaacttgtccgttgctgatatctctggtggtttcttcaaattcattcaaaccttgaaccacaactgtaagcctcacttcagagaatacttggttcaaaacatgtcctctgatgacaaggaatccattgtcatcatcagagacaacttgatgttctttgctggtgaaatcgctggtgaattaggtttaccatctatcatcttgagaggttctaacgctgtcatgttgactgcttccgatatcattccacaattgcaccaagaaggtagattcccaccaccagactctctattgcaagaaaccattccagaattggttccattcagatacaaggacttgccattcatcggttacccaattcaccaaaccttggaattctccattaccatgatgaccccaaagtctccagcttctgccatcttgatcaacactttagaattcttggaacaatctgctttgactcaaatccgtgaccactacaaggtcccagttttcactatcggtccattgcacaagattgtcactaccagatccacttccatcttggaagaagacacctcttgtatcaactggttggacaagcaatctccaaagtctgttgtctacgtttctctaggttctttggccaaattggacgaaaaggttgcttctgaaatggcttgtggtttggccatgtccaaccataaattcttatgggttgtcagaccaggtatggtccatggtttcgaatgggttgaatttttgccagactctttggttggtgaaatgaaggccagaggtttgattgtcaaatgggctccacaaaccactgttttggctcacaacgctgtcggtggtttttggtcccactgtggttggaactctactatcgaatgtttggctgaaggtgttccaatgatgtgtcaacctttcttcgctgaccaattgttgaatgctcgttacgtttccgatgtctggaagaccggtttcgaaattgtcattgaaaagggtgaaattgcttgtgccatcaagagagttttggtcgatgaagaaggtgaagaaatgagacaaagagctatggaaatcaaggaaaaggtcaagattgccatcaacgatggtggttcttcttacgactctttcaaggatttggttgctttcatctcctctttg

SEQ ID NO: 233 - protein, 424 aa, Artificial Sequence
  Synthetic construct
MLQLATYLHSQGISITIAQYPNFNSPDSSNHPELTFLPLSSGNLSVADISGGFFKFIQTLNHNCKPHFREYLVQNMSSDDKESIVIIRDNLMFFAGEIAGELGLPSIILRGSNAVMLTASDIIPQLHQEGRFPPPDSLLQETIPELVPFRYKDLPFIGYPIHQTLEFSITMMTPKSPASAILINTLEFLEQSALTQIRDHYKVPVFTIGPLHKIVTTRSTSILEEDTSCINWLDKQSPKSVVYVSLGSLAKLDEKVASEMACGLAMSNHKFLWVVRPGMVHGFEWVEFLPDSLVGEMKARGLIVKWAPQTTVLAHNAVGGFWSHCGWNSTIECLAEGVPMMCQPFFADQLLNARYVSDVWKTGFEIVIEKGEIACAIKRVLVDEEGEEMRQRAMEIKEKVKIAINDGGSSYDSFKDLVAFISSL

SEQ ID NO: 234 - DNA, 1422 bp, Artificial Sequence
  Synthetic construct
atgtctacctctgaattggttttcattccatctccaggtgctggtcatttgccaccaactgttgaattggccaaattgttgttgcaccgtgaccaaagattgtctgtcaccatcattgtcatgaacttatggttaggtccaaagcacaacactgaagccagaccatgtgttccttccttgagattcgtcgatatcccatgtgacgaatctaccatggctttgatctctccaaacactttcatctctgcctttgtcgaacaccacaagccaagagttcgtgacatcgttcgtggtatcattgaatctgactctgtcagattggctggtttcgtcttggacatgttctgtatgccaatgtccgatgttgctaacgaatttggtgttccatcttacaactacttcacctctggtgctgccactttaggtttgatgttccatttgcaatggaagagagatcacgaaggttacgacgctactgaattgaagaactctgacactgaattatctgtcccatcttacgttaaccctgttccagccaaggtcttgccagaagttgttttggacaaggaaggtggttccaagatgttcttggatttggctgaaagaatcagagaatccaagggtatcatcgttaactcttgtcaagctattgaaagacacgctttggaatacctatcctccaacaacaacggtattccacctgttttcccagtcggtccaatcttgaacttggaaaacaagaaggacgatgctaagactgacgaaatcatgagatggttgaacgaacaaccagaatcctctgttgttttcttgtgtttcggttccatgggttctttcaacgaaaagcaagtcaaagaaattgctgttgccattgaaagatctggtcacagatttttatggtctttgagaagaccaactccaaaggaaaagattgaattcccaaaggaatacgaaaacttggaagaagtcttaccagaaggtttcttgaagagaacctcttctatcggtaaggttatcggttgggctccacaaatggctgtcttgtcccacccatccgtcggtggtttcgtttcccactgtggttggaactccactttggaatccatgtggtgtggtgtcccaatggctgcttggccattatacgctgaacaaactttgaatgctttcttgttggttgtcgaattgggtttggctgctgaaattagaatggactacagaaccgataccaaggctggttacgatggtggtatggaagtcaccgttgaagaaattgaagacggtatcagaaagttgatgtctgacggtgaaatcagaaacaaggtcaaggatgtcaaggaaaaatccagagctgccgttgttgagggtggttcttcttacgcttccattggtaaattcatcgaacacgtttccaacgtcaccata

SEQ ID NO: 235 - protein, 474 aa, Artificial Sequence
  Synthetic construct
MSTSELVFIPSPGAGHLPPTVELAKLLLHRDQRLSVTIIVMNLWLGPKHNTEARPCVPSLRFVDIPCDESTMALISPNTFISAFVEHHKPRVRDIVRGIIESDSVRLAGFVLDMFCMPMSDVANEFGVPSYNYFTSGAATLGLMFHLQWKRDHEGYDATELKNSDTELSVPSYVNPVPAKVLPEVVLDKEGGSKMFLDLAERIRESKGIIVNSCQAIERHALEYLSSNNNGIPPVFPVGPILNLENKKDDAKTDEIMRWLNEQPESSVVFLCFGSMGSFNEKQVKEIAVAIERSGHRFLWSLRRPTPKEKIEFPKEYENLEEVLPEGFLKRTSSIGKVIGWAPQMAVLSHPSVGGFVSHCGWNSTLESMWCGVPMAAWPLYAEQTLNAFLLVVELGLAAEIRMDYRTDTKAGYDGGMEVTVEEIEDGIRKLMSDGEIRNKVKDVKEKSRAAVVEGGSSYASIGKFIEHVSNVTI

SEQ ID NO: 236 - DNA, 1437 bp, Artificial Sequence
  Synthetic construct
atggcctccattgctgaaatgcaaaagcctcatgccatctgtatcccatacccagctcaaggtcacatcaacccaatgatgcaatttgccaaattgttgcacttcaagggtttccacatctctttcgttaacaaccattacaaccacaagagattacaaagatctagaggtctatccgctttggaaggtttgccagacttccacttctactccatcccagatggtttgcctccatctaacgctgaagctactcaatccattccaggtctatgtgaatctattccaaagcactctttggaaccattctgtgacttgattgccactttgaatggttctgatgttccaccagtctcctgtatcatctctgacggtgtcatgtctttcactttgcaagctgctgaaagattcggtttaccagaagtcttattctggactccatctgcttgtggtttcttggcttacactcactacagagatttggttgacaaagaatacattccattgaaggacaccaatgatttgaccaacggttacttggaaacttctttggactggatcccaggtatgaagaacatcagattaaaggacttcccatctttcatcagaaccaccgatatcaacgatatcatgttgaactacttcttgattgaaactgaagccattccaaagggtgttgccatcatcttgaacactttcgatgctttggaaaaggactctatcactccagtcttggctttgaaccctcaaatctacaccatcggtccattgcacatgatgcaacaatacgtcgaccatgatgaaagattgaagcacattggttccaacttatggaaggaagacgtttcttgtatcaactggttggacaccaagaagccaaactccgttgtctacgtcaactttggttccatcactgttatgaccaaggaacaattgattgaattcggttggggtttggctaactctaagaaggacttcttatggatcaccagaccagacattgttggtggtaacgaagctatgattccagctgaattcattgaagaaaccaaggaaagaggtatggttacttcctggtgttcccaagaagaagttttgaagcacccatccattggtgttttcttgacccactctggttggaactccaccattgaatccatctctaacggtgttccaatgatctgttggccattcttcgctgaacaacaaaccaactgtcgttactgttgtgtcgaatgggaaatcggtttggaaattgacactgacgtcaagcgtgaagaagttgaagctcaagttagagaaatgatggatggttctaagggtaagatgatgaaaaacaaggctttggaatggaagaagaaggctgaagaagctgtctctattggtggttcttcttacttgaactttgaaaaattggtcaccgatgtcttgttgcgcaaa

SEQ ID NO: 237 - protein, 479 aa, Artificial Sequence
  Synthetic construct
MASIAEMQKPHAICIPYPAQGHINPMMQFAKLLHFKGFHISFVNNHYNHKRLQRSRGLSALEGLPDFHFYSIPDGLPPSNAEATQSIPGLCESIPKHSLEPFCDLIATLNGSDVPPVSCIISDGVMSFTLQAAERFGLPEVLFWTPSACGFLAYTHYRDLVDKEYIPLKDTNDLTNGYLETSLDWIPGMKNIRLKDFPSFIRTTDINDIMLNYFLIETEAIPKGVAIILNTFDALEKDSITPVLALNPQIYTIGPLHMMQQYVDHDERLKHIGSNLWKEDVSCINWLDTKKPNSVVYVNFGSITVMTKEQLIEFGWGLANSKKDFLWITRPDIVGGNEAMIPAEFIEETKERGMVTSWCSQEEVLKHPSIGVFLTHSGWNSTIESISNGVPMICWPFFAEQQTNCRYCCVEWEIGLEIDTDVKREEVEAQVREMMDGSKGKMMKNKALEWKKKAEEAVSIGGSSYLNFEKLVTDVLLRK

SEQ ID NO: 238 - DNA, 1374 bp, Artificial Sequence
  Synthetic construct
atggaaaacaagactgaaactaccgttcgtcgtagaagaagaatcatcttattcccagttccagttcaaggtcacatcaacccaattttgcaattggctaacgtcttatactccaagggtttctccatcactattttccacactaacttcaacaagccaaagacctccaactacccacacttcaccttcagatttattttggacaatgaccctcaagatgtcagaatctccaacttgccaactcacggtccattgaccgtcatgagaattttgatcatcaacgaacacggtgctgatgaattgcaaagagaattggaattgttgatgttggcctccgaagaagacggtgaagtctcctgtttgattaccgaccaaatctggtacttcacccaatctgttgctgactctttgaacttgagaagattggttttgatgacttcttctttgttcaacttccacgctcatgtttctttgcctcaattcgatgaattgggttacttggacccagacgacaagactagattagaagaacaagcttctggtttcccaatgttgaaggtcaaggatatcaaatgtggtttctctatgtggaagcaaggtaaggaaatctttgaaaacatcaccaagcaaaccaaggcttcttctggtgtcatctggaactctttcaaggaattggaagaatctgaattggaaaccgtcatcagagaaatcccagctccatccttcttgattccattgccaaagcatttgactgcttcctcttcttctctattagaccacgacagaactgttttcccatggttagaccaacaaccatctcgttctgtcttgtacgtttctttcggttctgctactgaagtcgatgctaaggacttcttggaaattgctcgtggtttggtcgactccaagcaatctttcttatgggttgttagaccaggtttcgtcaagggttccacctgggttgaaccattgccagatggtttcttgggtgaaagaggtagaattgtcaaatgggttccacaacaagaagttttggctcacggtgccattggtgctttctggacccactctggttggaactccactttggaatccgtttgtgaaggtgttccaatgattttctctgcctttgcctttgaccaaccattaaacgctagatacatgtccgatgtcttgaaggttggtgtctacttggaaaacggttgggaaagaggtgaaattgccaacgccatcagaagagttatggtcgatgaagaaggtggttacatcagacaaaacgcttccgtcttgaagcaaaaggctgatgtttccttgatgaagggtggttcttcttacgaatctctagaatctttggttgcttacatctccagctta

SEQ ID NO: 239 - protein, 458 aa, Artificial Sequence
  Synthetic construct
MENKTETTVRRRRRIILFPVPVQGHINPILQLANVLYSKGFSITIFHTNFNKPKTSNYPHFTFRFILDNDPQDVRISNLPTHGPLTVMRILIINEHGADELQRELELLMLASEEDGEVSCLITDQIWYFTQSVADSLNLRRLVLMTSSLFNFHAHVSLPQFDELGYLDPDDKTRLEEQASGFPMLKVKDIKCGFSMWKQGKEIFENITKQTKASSGVIWNSFKELEESELETVIREIPAPSFLIPLPKHLTASSSSLLDHDRTVFPWLDQQPSRSVLYVSFGSATEVDAKDFLEIARGLVDSKQSFLWVVRPGFVKGSTWVEPLPDGFLGERGRIVKWVPQQEVLAHGAIGAFWTHSGWNSTLESVCEGVPMIFSAFAFDQPLNARYMSDVLKVGVYLENGWERGEIANAIRRVMVDEEGGYIRQNASVLKQKADVSLMKGGSSYESLESLVAYISSL

SEQ ID NO: 240 - DNA, 1377 bp, Artificial Sequence
  Synthetic construct
atggaaaacaagactgaaactactgtcagaagaagacgtcgtatcatcttgttcccagttccattccaaggtcacatcaacccaatgttacaattagctaacgtcttgtactccaagggtttctccatcaccattttccacaccaacttcaacaagccaaagacttctaactacccacacttcactttcagatttatcttggacaacgaccctcaagatgtcagaatttccaacttgccaacccacggtccattggctgtcatgagaattttgatcatcaacgaacacggtgccgacgaattgagaagagaattggaattgttgatgttggcttctgaagaagatggtgaagtttcctgtttgattgctgaccaaatctggtacttcacccaatctgttgctgactctttgaacttgagaagattggtcttggtcacttcttctttgttcaacttccacgctcatgtctctttgccacaatttgacgaattgggttacttggacccagatgacaagaccagattggaagaacaagcttctggtttcccaatgttgaaggttaaggatatcaaatgttctttctccatgtggaagaaatacaaggaatactttgaaaacatcaccaagcaaaccaaggcctcctccggtgttatctggaactctttcaaggaattagaagaatctgaattggaaactgttatcagagaaattccagctccatctttcttaatcccattaccaaagcatttgactgcttcttcttcctctttgttggaccacgacagaaccgttttcccatggttggaccaacaaccatccagatctgtcttgtacgtttctttcggttctggtactgaagtcttagatgaaaaggacttcttggaaattgccagaggtttagtcgactccaagcaatctttcttgtgggttgttagaccaggtttcgtcaagggttccacctgggttgaaccattgccagatggtttcttgggtgaaagaggtagaattgtcaaatgggttcctcaacaagaagttttggctcacggtgccattggtgctttctggacccactctggttggaactccactttggaatctgtttgtgaaggtgttccaatgattttctccgatttcggtctagaccaaccattgaacgctcgttacatgtccgatgttttgaaggttggtgtctacttggaaaacggttgggaaagaggtgaaattgctaacgccatcagaagagtcatggttgacgaagaaggtgaatacatcagacaaaatgctcgtgtcttgaaacaaaaggctgatgtttctttgatgaagggtggttcttcttacgaatccttggaatctttagtctcttacatctcctcctta

SEQ ID NO: 241 - protein, 459 aa, Artificial Sequence
  Synthetic construct
MENKTETTVRRRRRIILFPVPFQGHINPMLQLANVLYSKGFSITIFHTNFNKPKTSNYPHFTFRFILDNDPQDVRISNLPTHGPLAVMRILIINEHGADELRRELELLMLASEEDGEVSCLIADQIWYFTQSVADSLNLRRLVLVTSSLFNFHAHVSLPQFDELGYLDPDDKTRLEEQASGFPMLKVKDIKCSFSMWKKYKEYFENITKQTKASSGVIWNSFKELEESELETVIREIPAPSFLIPLPKHLTASSSSLLDHDRTVFPWLDQQPSRSVLYVSFGSGTEVLDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 242 - DNA, 1419 bp, Artificial Sequence
  Synthetic construct
atggctacttctgactccattgtcgatgacagaaagcaattgcacgttgccactttcccatggttggctttcggtcacattttgccattcttgcaattgtccaaattgattgctgaaaagggtcacaaggtttctttcttgtccactaccagaaacatccaaagattatcttctcacatctctccattgatcaacgttgtccaattgactttgccaagagtccaagaattgccagaagatgctgaagctaccaccgatgtccacccagaagatatccaatacttgaagaaggctgtcgatggtttgcaaccagaagtcaccagattcttggaacaacactctccagactggatcatctacgacttcacccactactggttaccatccattgctgcttctttgggtatctccagagcttacttctgtgtcatcactccatggaccattgcttacttggctccatcttctgatgccatgatcaacgactctgacggtagaaccactgttgaagatttgaccactccacctaaatggttcccattcccaaccaaggtttgttggagaaagcatgacttggccagaatggaaccttacgaagctccaggtatttctgatggttacagaatgggtatggttttcaagggttctgactgtctattattcaaatgttaccatgaattcggtactcaatggttgccattgttggaaactttgcaccaagttccagttgttccagtcggtttgttgccaccagaaattccaggtgatgaaaaggatgaaacctgggtttccatcaagaaatggttggacggtaagcaaaagggttccgttgtctacgttgctttgggttctgaagctttggtttctcaaactgaagttgtcgaattggctttgggtctagaattgtccggtttaccatttgtctgggcttacagaaagccaaagggtccagccaaatctgattccgtcgaattaccagacggtttcgtcgaaagaacccgtgaccgtggtttagtctggacttcctgggctccacaattgagaatcttgtcccacgaatccgtttgtggtttcttgactcactgtggttctggttctattgtcgaaggtttgatgttcggtcacccattgattatgttgcctttgtttggtgaccaaccattaaacgctagattattggaagacaagcaagtcggtatcgaaattccaagaaacgaagaagacggttgtttgaccaaggaatccgttgctcgttctttgagatccgttgttgtcgaaaacgaaggtgaaatctacaaggccaacgccagagaattgtctaagatctacaacgacaccaaggttgaaaaggaatacgtttctcaatttgtcgactacttggaaaagaacgctagagctgttgccatcgaccacgaaagc

SEQ ID NO: 243 - protein, 473 aa, Artificial Sequence; identical to SEQ ID NO: 166
  Synthetic construct

SEQ ID NO: 244 - DNA, 1419 bp, Artificial Sequence
  Synthetic construct
atggctacctctgactccattgtcgatgaccgtaaacaattgcacgttgctactttcccatggttggctttcggtcacatcttgccttacttgcaattgtccaagttgattgctgaaaagggtcacaaggtttctttcttgtccactactagaaacatccaaagattatcttctcacatctctccattgatcaacgttgtccaattgactttgccaagagttcaagaattaccagaagatgctgaagctaccaccgatgtccacccagaagacattccatacttgaagaaggcctctgacggtttgcaaccagaagtcactagattcttggaacaacactctccagactggatcatctacgactacactcactactggttgccatccattgctgcttctttgggtatctccagagcccatttctccgtcaccactccatgggctattgcttacatgggtccatctgctgatgctatgatcaacggttctgacggtagaaccaccgtcgaagatttgactaccccacctaaatggttcccattcccaaccaaggtttgttggagaaagcatgatttggccagattagtcccatacaaggctccaggtatttctgatggttacagaatgggtttggtcttgaaaggttctgactgtttgttgtccaaatgttaccacgaattcggtactcaatggttaccattgttggaaactttgcaccaagttccagttgttccagtcggtttgttgcctccagaagttccaggtgacgaaaaggatgaaacctgggtttccatcaagaaatggttggatggtaagcaaaagggttccgttgtctacgttgctttgggttctgaagtcttggtcagccaaactgaagttgtcgaattggctttaggtttggaattgtccggtctaccatttgtctgggcttacagaaagccaaagggtccagctaagtctgactccgttgaattgccagatggtttcgtcgaaagaaccagagacagaggtttggtttggacttcttgggctccacaattgagaatcttatctcacgaatctgtttgtggtttcttgacccactgtggttctggttccatcgtcgaaggtttgatgttcggtcacccattaatcatgttgccaattttcggtgaccaaccattgaacgccagattattggaagacaagcaagtcggtattgaaattccaagaaacgaagaagatggttgtttgaccaaggaatccgttgccagatctctacgttctgttgttgtcgaaaaggaaggtgaaatctacaaggccaacgctcgtgaattatccaagatctacaacgacaccaaggttgaaaaggaatacgtttctcaatttgttgactacttggaaaagaacactagagctgttgccattgaccatgagtct

SEQ ID NO: 245 - protein, 473 aa, Artificial Sequence; identical to SEQ ID NO: 164
  Synthetic construct

SEQ ID NO: 246 - DNA, 1566 bp, Artificial Sequence; identical to SEQ ID NO: 36
  Synthetic construct

SEQ ID NO: 247 - DNA, 1503 bp, Artificial Sequence
  Synthetic construct
ttgaatcttttttcttcttctcttctctatattcattcttgaattaaacacacatcaacaatggccgagcagcagaagatcaagaagtctccccacgttctgctcatccccttccctctgcagggccacatcaaccccttcatccagttcggcaagcgactcatctccaagggtgtcaagaccactctggtcaccaccatccacaccctcaactccactctcaaccactccaacaccaccaccacctccatcgagatccaggccatctccgacggctgtgacgagggtggtttcatgtctgctggtgagtcttacctcgagactttcaagcaggtcggttccaagtctctggctgacctcatcaagaagctccagtccgagggtaccaccattgacgccatcatctacgactccatgaccgagtgggttctcgatgtcgccatcgagtttggtattgacggtggctccttcttcacccaggcctgtgtcgtcaactctctctactaccacgtccacaagggtctgatctctctgcccctcggcgagactgtctccgtccccggtttccccgttctgcagcgatgggagactcctctcattctccagaaccacgagcagatccagtccccctggtcccagatgctcttcggccagttcgccaacattgaccaggcccgatgggttttcaccaactccttctacaagctcgaggaagaggtcattgagtggacccgaaagatctggaacctcaaggtcattggccccaccctcccctccatgtacctcgacaagcgactcgatgacgacaaggacaacggtttcaacctctacaaggccaaccaccacgagtgcatgaactggctcgacgacaagcccaaggagtccgttgtctacgttgcctttggctctctggtcaagcacggccccgagcaggttgaggagatcacccgagctctgattgactccgatgtcaacttcctgtgggtcatcaagcacaaggaagagggtaagctccccgagaacctgtccgaggtcatcaagaccggcaagggcctcattgttgcctggtgcaagcagctcgacgttctcgcccacgagtccgtcggctgctttgtcacccactgcggtttcaactccaccctcgaggctatctctctcggtgtccccgttgttgccatgccccagttctccgaccagaccaccaacgccaagctcctcgatgagattctcggtgtcggtgtccgagtcaaggctgacgagaacggtattgtccgacgaggtaacctggcttcttgtatcaagatgatcatggaggaagagcgaggtgtcatcatccgaaagaacgccgtcaagtggaaggatctggccaaggttgctgtccacgagggtggctcttccgacaacgacattgtcgagtttgtctccgagctcatcaaggcctaaacttcgagctaatccagtagcttacgttacccaggggcaggtcaactggctagccacgag

SEQ ID NO: 248 - DNA, 1497 bp, Artificial Sequence; identical to SEQ ID NO: 39
  Synthetic construct

SEQ ID NO: 249 - DNA, 1542 bp, Artificial Sequence; identical to SEQ ID NO: 37
  Synthetic construct

The invention claimed is:

1. A recombinant yeast comprising one or more polynucleotide(s) encoding one or more polypeptide(s) having uridine diphosphate-dependent glycosyltransferase (UGT) activity, wherein said recombinant yeast comprises a mutation, insertion, substitution, or deletion in a serine/threonine protein kinase gene selected from serine/threonine protein kinase 1 (PSK1) and serine/threonine protein kinase 2 (PSK2) that reduces the kinase activity relative to the corresponding yeast lacking the mutation, insertion, substitution, or deletion.

2. The recombinant yeast according to claim 1, wherein the serine/threonine protein kinase 1 or serine/threonine protein kinase 2 activity is reduced by at least 40%.

3. The recombinant yeast according to claim 1, comprising one or more polynucleotide expression constructs selected from the group consisting of:

(a) a polynucleotide expression construct encoding a functional UGT1 polypeptide, (b) a polynucleotide expression construct encoding a functional UGT3 polypeptide, (c) a polynucleotide expression construct encoding a functional UGT4 polypeptide, (d) a polynucleotide expression construct encoding a first functional UGT2 polypeptide, and (e) a polynucleotide expression construct encoding a second functional UGT2 polypeptide.

4. The recombinant yeast according to claim 1, comprising one or more polynucleotide expression constructs selected from the group consisting of:

(a) a polynucleotide expression construct encoding a UGT1 polypeptide capable of glycosylating steviol or a precursor steviol glycoside at a C-13 hydroxyl group present in said steviol or precursor steviol glycoside, wherein the glycosylation is a beta-glycosylation;

(b) a polynucleotide expression construct encoding a UGT3 polypeptide capable of glycosylating steviol or a precursor steviol glycoside at a C-19 carboxyl group present in said steviol or precursor steviol glycoside, wherein the glycosylation is a beta-glycosylation;

(c) a polynucleotide expression construct encoding a UGT4 polypeptide capable of beta 1,3 glycosylation of the C3' of a 13-O-glucose, of a 19-O-glucose or both the 13-O-glucose and the 19-O-glucose of a precursor steviol glycoside having a 13-O-glucose, a 19-O-glucose, or both a 13-O-glucose and a 19-O-glucose;

(d) a polynucleotide expression construct encoding a first UGT2 polypeptide capable of beta 1,2 glycosylation of the C2' of the 13-O-glucose, of the 19-O-glucose or both the 13-O-glucose and the 19-O-glucose of a precursor steviol glycoside having a 13-O-glucose, a 19-O-glucose, or both the 13-O-glucose and the 19-O-glucose; and (e) a polynucleotide expression construct encoding a second UGT2 polypeptide capable of beta 1,2 glycosylation of the C2' of the 13-O-glucose, of the 19-O-glucose or both the 13-O-glucose and the 19-O-glucose of the precursor steviol glycoside having a 13-O-glucose, a 19-O-glucose, or both the 13-O-glucose and the 19-O-glucose, wherein the second UGT2 polypeptide has an higher beta 1,2 glycosylation activity at the C2' of the 19-O-glucose in the precursor steviol glycoside if compared with the same activity in the first UGT2 polypeptide;

wherein the recombinant yeast produces a steviol glycoside selected from the group consisting of: steviol-13-O-glucoside, steviol-19-O-glucoside, steviol-1,2-bioside, steviol-1,3-bioside, stevioside, rebaudioside A, rebaudioside B, rebaudioside C, rebaudioside D, rebaudioside E, rebaudioside F, rebaudioside I, rebaudioside Q, rebaudioside M, rubusoside, and dulcoside A.

5. The recombinant yeast according to claim 1, additionally comprising a polynucleotide selected from the group consisting of:

(f) a polynucleotide expression construct encoding a geranyl-geranyl pyrophosphate synthase (GGPPS), (g) a polynucleotide expression construct encoding an ent-copalyl diphosphate synthase (CDPS), (h) a polynucleotide expression construct encoding a kaurene oxidase (KO), (i) a polynucleotide expression construct encoding a kaurene synthase (KS), and (j) a polynucleotide expression construct encoding a kaurenoic acid 13-hydroxylase (KAH); and wherein the yeast produces a steviol glycoside, selected from the group consisting of: steviol-13-O-glucoside, steviol-19-O-glucoside, steviol-1,2-bioside, steviol-1,3-bioside, stevioside, rebaudioside A, rebaudioside B, rebaudioside C, rebaudioside D, rebaudioside E, rebaudioside F, rebaudioside I, rebaudioside Q, rebaudioside M, rubusoside, and dulcoside A.

6. The recombinant yeast according to claim 1, wherein the recombinant yeast additionally comprises, a polynucleotide encoding a cytochrome P450 reductase (CPR).

7. The recombinant yeast according to claim 1, wherein the ability of the recombinant yeast to produce geranylgeranyl diphosphate (GGPP) is upregulated.

8. The recombinant yeast according to claim 7, comprising one or more polynucleotide(s) encoding hydroxymethylglutaryl-CoA reductase, farnesyl-pyrophosphate synthetase and geranylgeranyl diphosphate synthase, whereby expression of the polynucleotide(s) confer(s) on the recombinant yeast the ability to produce elevated levels of GGPP.

9. The recombinant yeast according to claim 1, wherein the recombinant yeast belongs to one of the genera *Saccharomyces, Pichia, Kluyveromyces, Candida, Hansenula, Trichosporon, Brettanomyces, Pachysolen, Yarrowia*, or *Yamadazyma*.

10. The recombinant yeast according to claim 9, wherein the recombinant yeast is a *Saccharomyces cerevisiae* cell, or a *Yarrowia lipolytica* cell.

11. A process for producing a steviol glycoside which process comprises culturing the recombinant yeast according to claim 2 under conditions conducive to production of the steviol glycoside, and recovering the steviol glycoside.

12. A process for producing a steviol glycoside comprising contacting steviol or steviol glycosides with the recombinant yeast according to claim 1, a fermentation broth comprising such recombinant yeast, and recovering the steviol glycoside.

13. The process according to claim 12, wherein the process is a whole cell bioconversion process.

14. The process according to claim 13, wherein steviol is converted to steviol-13-O-glucoside by a UGT1, wherein the UGT1 is a UGT85C2, steviol-19-O-glucoside is converted to rubusoside by a UGT1, wherein the UGT1 is a UGT85C2, steviol-13-O-glucoside is converted to rubusoside by a UGT3, wherein the UGT3 is a UGT74G1, steviol-1,2-bioside is converted to 1,2-stevioside by a UGT3, wherein the UGT3 is a UGT74G1, rebaudioside B is converted to rebaudioside A by a UGT3, wherein the UGT3 is a UGT74G1, steviol-1,2-bioside is converted to rebaudioside B by a UGT 4, wherein the UGT 4 is a UGT76G1, 1,2-stevioside is converted to rebaudioside A by a UGT 4, wherein the UGT 4 is a UGT76G1, rebaudioside E is converted to rebaudioside D by a UGT 4, wherein the UGT 4 is a UGT76G1, rebaudioside D is converted to rebaudioside M by a UGT 4, wherein the UGT 4 is a UGT76G1, steviol 13-O-glucoside is converted to steviol-1,2-bioside by a UGT2, wherein the UGT2 is a UGT91 D2e, rubusoside is converted to 1,2-stevioside by a UGT2, wherein the UGT2 is a UGT91 D2e, stevioside is converted to rebaudioside E, by a UGT2, wherein the UGT2 is a UGT91 D2e and a EUGT11, and rebaudioside A is converted to rebaudioside D by a UGT2, wherein the UGT2 is a EUGT11.

15. The recombinant yeast of claim 4, wherein the one or more polynucleotide expression constructs is selected from the group consisting of:

(a) the polynucleotide expression construct encoding a UGT1 polypeptide, wherein the polynucleotide encodes for a UGT85C2 polypeptide;

(b) the polynucleotide expression construct encoding a UGT3 polypeptide, wherein the polynucleotide encodes for a UGT74G1 polypeptide;

(c) the polynucleotide expression construct encoding a UGT4 polypeptide, wherein the polynucleotide encodes for a UGT76G1 polypeptide;

(d) the polynucleotide expression construct encoding a UGT2 polypeptide, wherein the polynucleotide encodes for a UGT91 d2 polypeptide or a UGT2 polypeptide having at least uridine 5'-diphosphoglucosyl: steviol-13-O-glucoside transferase activity; and (e) the polynucleotide expression construct encoding a second UGT2 polypeptide, wherein the polynucleotide encodes for a EUGT11 polypeptide.

* * * * *